(12) United States Patent
Breuer et al.

(10) Patent No.: US 10,954,538 B2
(45) Date of Patent: Mar. 23, 2021

(54) ENZYMATIC CYCLIZATION OF HOMOFARNESYLIC ACID

(71) Applicant: BASF SE, Ludwigshafen am Rhein (DE)

(72) Inventors: Michael Breuer, Darmstadt (DE); Wolfgang Siegel, Limburgerhof (DE); Stefan Ruedenauer, Weinheim (DE); Ralf Pelzer, Fürstenberg (DE)

(73) Assignee: BASF SE

( * ) Notice: Subject to any disclaimer, the term of this patent is extended or adjusted under 35 U.S.C. 154(b) by 0 days.

(21) Appl. No.: 15/999,299

(22) PCT Filed: Feb. 20, 2017

(86) PCT No.: PCT/EP2017/053795
§ 371 (c)(1),
(2) Date: Aug. 18, 2018

(87) PCT Pub. No.: WO2017/140909
PCT Pub. Date: Aug. 24, 2017

(65) Prior Publication Data
US 2019/0144899 A1 May 16, 2019

(30) Foreign Application Priority Data
Feb. 19, 2016 (EP) .................... 16156410

(51) Int. Cl.
*C12P 17/04* (2006.01)
(52) U.S. Cl.
CPC ....... *C12P 17/04* (2013.01); *C12Y 402/01129* (2013.01); *C12Y 504/99017* (2013.01)
(58) Field of Classification Search
None
See application file for complete search history.

(56) References Cited

U.S. PATENT DOCUMENTS

| | | | |
|---|---|---|---|
| 6,596,520 B1 | 7/2003 | Friedrich et al. | |
| 7,785,847 B2 | 8/2010 | Stürmer et al. | |
| 8,759,043 B2 | 6/2014 | Breuer et al. | |
| 9,856,199 B2 | 1/2018 | Hickmann et al. | |
| 9,920,007 B2 | 3/2018 | Rudenauer et al. | |
| 9,950,982 B2 | 4/2018 | Bru Roig et al. | |
| 9,994,540 B2 | 6/2018 | Rudenauer et al. | |
| 10,017,464 B2 | 7/2018 | Schafer et al. | |
| 10,017,465 B2 | 7/2018 | Schafer et al. | |
| 10,017,466 B2 | 7/2018 | Schafer et al. | |
| 10,023,550 B2 | 7/2018 | Stork et al. | |
| 10,053,409 B2 | 8/2018 | Bru Roig et al. | |
| 10,053,410 B2 | 8/2018 | Rudenauer et al. | |
| 10,087,395 B2 | 10/2018 | Pelzer et al. | |
| 10,106,477 B2 | 10/2018 | Fenlon et al. | |
| 10,106,517 B2 | 10/2018 | Rudenauer et al. | |
| 10,112,882 B2 | 10/2018 | Thrun et al. | |
| 2012/0237991 A1 | 9/2012 | Breuer et al. | |
| 2017/0037022 A1 | 2/2017 | Stork et al. | |
| 2017/0233780 A1 | 8/2017 | Breuer et al. | |
| 2017/0233874 A1 | 8/2017 | Aust et al. | |
| 2017/0292084 A1 | 10/2017 | Stork et al. | |
| 2017/0305849 A1 | 10/2017 | Schafer et al. | |
| 2018/0073047 A1 | 3/2018 | Navickas et al. | |
| 2018/0105838 A1 | 4/2018 | Schrader et al. | |
| 2018/0134680 A1 | 5/2018 | Siegel et al. | |
| 2018/0148753 A1 | 5/2018 | Navickas et al. | |
| 2018/0170850 A1 | 6/2018 | Vautravers et al. | |
| 2018/0208532 A1 | 7/2018 | Parvulescu et al. | |
| 2018/0208533 A1 | 7/2018 | Rudenauer et al. | |
| 2018/0230176 A1 | 8/2018 | Puhl et al. | |
| 2018/0244613 A1 | 8/2018 | Rudenauer et al. | |
| 2018/0265443 A1 | 9/2018 | Vautravers et al. | |
| 2018/0273458 A1 | 9/2018 | Strautmann et al. | |
| 2018/0290959 A1 | 10/2018 | Thrun et al. | |
| 2018/0305636 A1 | 10/2018 | Kolter et al. | |
| 2018/0312458 A1 | 11/2018 | Thrun et al. | |
| 2018/0346397 A1 | 12/2018 | Bru Roig et al. | |
| 2018/0346478 A1 | 12/2018 | Werner et al. | |
| 2018/0362353 A1 | 12/2018 | Vautravers et al. | |

FOREIGN PATENT DOCUMENTS

| | | |
|---|---|---|
| DE | 10019377 A1 | 10/2001 |
| EP | 204009 A1 | 12/1986 |
| EP | 1069183 A2 | 1/2001 |
| EP | 1149849 A1 | 10/2001 |
| WO | WO-2005108590 A2 | 11/2005 |
| WO | WO-2006094945 A2 | 9/2006 |

(Continued)

OTHER PUBLICATIONS

Miriam Seitz et al (Synthesis of Heterocyclic Terpenoids by Promiscuous Squalene-Hopene Cyclases (ChemBioChem 2013, 14, 436-439 (Year: 2013).*
U.S. Appl. No. 15/768,645, Kolter et al.
U.S. Appl. No. 16/074,168, Puhl et al.
Büchi et al., "110. The Synthesis of Racemic *Ambrox*," Helvetica Chimca Acta, vol. 72, pp. 996-1000, 1989.
Mookherjee et al., "Tobacco Constituents—Their Importance in Flavor and Fragrance Chemistry," Parfume & Flavorists, vol. 15, pp. 27-49, 1990.
Neumann et al., "Purification, Partial Characterization and Substrate Specifity of a Squalene Cyclase from *Bacillus acidocaldarius*," Biol. Chem., Hoppe-Seyler, vol. 367, pp. 723-729, 1986.

(Continued)

*Primary Examiner* — Kagnew H Gebreyesus
(74) *Attorney, Agent, or Firm* — Faegre Drinker Biddle & Reath LLP

(57) ABSTRACT

The present invention relates to processes for the preparation of sclareolide and related compounds by the biocatalytic cyclization of polyunsaturated carboxylic acid compounds, in particular of homofarnesylic acid and related compounds; and to a process for the preparation of ambroxide via the biocatalytic cyclization of homofarnesylic acid to sclareolide.

11 Claims, 1 Drawing Sheet
Specification includes a Sequence Listing.

(56) References Cited

FOREIGN PATENT DOCUMENTS

WO     WO-2010139719 A2    12/2010
WO     WO-2012066059 A2     5/2012

OTHER PUBLICATIONS

Ochs et al., "Cloning, Expression, and Sequencing of Squalene-Hopene Cyclase, a Key Enzyme in Triterpenoid Metabolism," Journal of Bacteriology, vol. 174, No. 1, pp. 298-302, 1992.

Seitz et al., "Synthesis of Heterocyclic Terpenoids by Promiscuous Squalene-Hopene Cyclases," ChemBioChem, vol. 14, pp. 436-439, 2013.

Seitz et al., "Synthesis of Heterocyclic Terpenoids by Promiscuous Squalene-Hopene Cyclases—Supporting Information," ChemBioChem, vol. 14, pp. 436-439, 2013.

Stoll et al., "161. Odeur et Constitution III). Les substances bicyclohomofarnésiques," Helvetica Chimica Acta, vol. 33, No. 160-161, pp. 1251-1260, 1950.

U.S. Appl. No. 15/768,645, filed Apr. 16, 2018, Kolter et al.

U.S. Appl. No. 16/074,168, filed Jul. 31, 2018, Puhl et al.

International Search Report for PCT/EP2017/053795 dated May 29, 2017.

Written Opinion of the International Searching Authority for PCT/EP2017/053795 dated May 29, 2017.

Lucius, "Über die säurekatalysierte Cyclisation der Homofarnesylsäure," Chemische Berichte, vol. 93, pp. 2663-2667, 1960.

\* cited by examiner

ENZYMATIC CYCLIZATION OF HOMOFARNESYLIC ACID

CROSS-REFERENCE TO RELATED APPLICATIONS

This application is a national stage application (under 35 U.S.C. § 371) of PCT/EP2017/053795, filed Feb. 20, 2017, which claims benefit of European Application No. 16156410.9, filed Feb. 19, 2016, both of which are incorporated herein by reference in their entirety.

SEQUENCE LISTING

The Sequence Listing associated with this application is filed in electronic format via EFS-Web and hereby incorporated by reference into the specification in its entirety. The name of the text file containing the Sequence Listing is 074012_0396 US_580360_SL.txt. The size of the text file is 1,578,984 bytes and the text file was created on Sep. 12, 2018.

The present invention relates to processes for the preparation of sclareolide and related compounds by the biocatalytic cyclization of polyunsaturated carboxylic acid compounds, in particular of homofarnesylic acid and related compounds; and to a process for the preparation of ambroxide via the biocatalytic cyclization of homofarnesylic acid to sclareolide.

BACKGROUND OF THE INVENTION

Compounds with the dodecahydronaphtho[2,1-b]furan skeleton are of great economic interest as aroma chemicals. In this context, compound (−)-2 should be mentioned; that is, (3aR,5aS,9aS,9bR)-3a,6,6,9a-tetramethyldodecahydronaphtho-[2,1-b]-furan, known as the laevorotatory stereoisomer of ambroxan.

Ambroxan has originally been obtained from sperm whale ambergris and currently can be prepared mainly via two routes. Sclareol (3), a constituent of clary sage (*Salvia sclarea*), is frequently used as suitable starting material for semisynthetic material because it already contains the optical information for compound ((−)-2). Here, the oxidative degradation may be carried out using chromic acid, permanganate, $H_2O_2$ or ozone [Stoll et al.; *Helv Chim Acta* (1950), 33: 1251]. The resulting sclareolide (4) is subsequently converted (for example using $LiAlH_4$ or $NaBH_4$) to ambrox-1,4-diol (5) [Mookherjee et al.; *Perfumer and Flavourist* (1990), 15: 27]. The preparation of compound (4) from sclareol (3) can also be effected by biotransformation with *Hyphozyma roseoniger* [EP 204009]

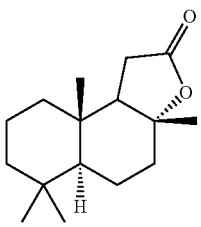

Sclareolide 4

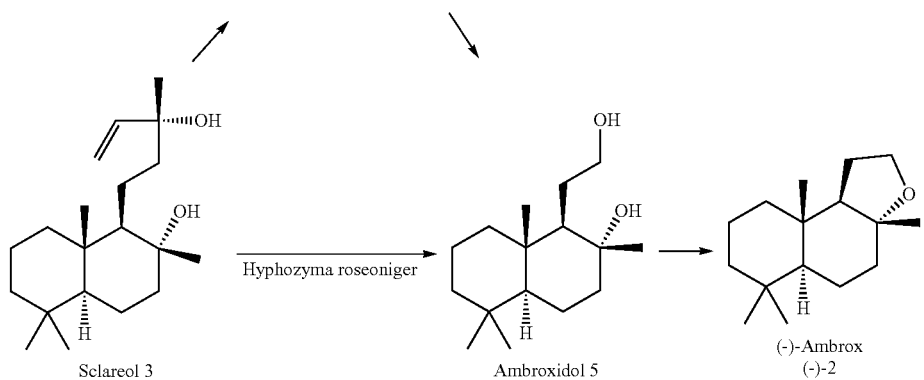

Sclareol 3    Ambroxidol 5    (−)-Ambrox (−)-2

Finally, ambrox-1,4-diol (5) can be cyclized in a series of chemical processes to give compound ((−)-2). Research has been carried out into the preparation of the racemate of ambroxan (rac-2) via inter alia homofarnesylic acid [U.S. Pat. No. 513,270; Lucius et al.; *Chem Ber* (1960), 93: 2663] and 4-(2,6,6-trimethylcyclohex-1-enyl)butan-2-one [Büchi et al.; *Helv Chim Acta* (1989), 72: 996].

In 2002, the market volume of ambroxan was, on average, 20 tonnes per year. This requires a starting base of approximately 33 tonnes of sclareol per year. The production of one tonne of ambroxan requires 207 tonnes of various individual substances, which, in turn, bring about the generation of 206 tonnes of waste. The accumulating substances have different but overall relatively potent effects on health and environment [Deutsche Bundesstiftung Umwelt]. Thus, this synthesis consumes a great deal of energy and requires the use of polluting chemicals.

The biocatalytic synthesis of compound ((−)-2) has been described in the literature [Neumann et al.; *Biol Chem Hoppe Seyler* (1986), 367: 723]. Here, the molecule is obtained from homofarnesol (compound (1a), (3Z,7E)-4,8,12-trimethyltrideca-3,7,11-trien-1-ol). The catalyst used was the enzyme squalene-hopene cyclase (SHC) from *Alicyclobacillus acidocaldarius* (formerly *Bacillus acidocaldarius*). Further enzymes for catalyzing the cyclization of homofarnesol to ambroxan have been described in patent specifications (for example WO 2012/066059) and in the literature [Neumann et al., loc. cit.].

Seitz, M. et al describe in ChemBioChem 2013, 14, 436-439 an enzymatic process for the preparation of sclareolide from homofarnesylic acid using the squalene-hopene cyclase from *Zymomonas mobilis* (Zm SHCI). However, the product yields obtained therein are only approximately 7.7 to 22.9%.

It was an object of the present invention to provide an improved process for the preparation of ambroxide precursors, in particular of sclareolide and related compounds, which can be carried out in a technically more simple and a more economic fashion than traditional chemical processes (for example reduction of the number of reaction steps required, and/or more convenient starting materials). It was a further object to additionally reduce the arising costs by using readily available starting materials and by reducing the number of chemical reactions (or steps). In particular, an improved biocatalytic process for the preparation of sclareolide should be provided.

SUMMARY OF THE INVENTION

The above objects were achieved by providing a process for the preparation of ambroxide precursors, preferably sclareolide, of the general formula (4), characterized in that homofarnesylic acid derivatives, in particular homofarnesylic acid of the general formula is cyclized biocatalytically, as explained in more detail in the following.

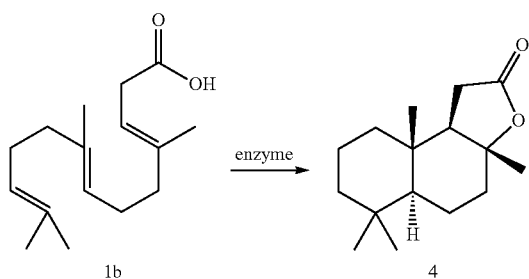

DETAILED DESCRIPTION OF THE INVENTION

A. General Definitions

Figure 1A:
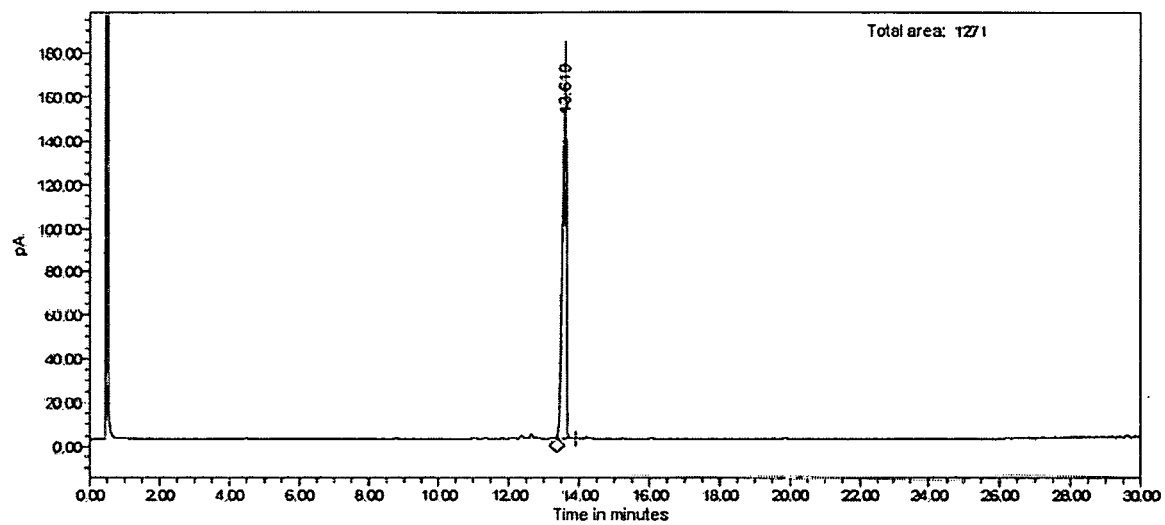
FIG. 1 shows the gas chromatography (GC) spectrum (A) of a homofarnesylic acid cyclization product prepared in accordance with the invention in comparison with (B) the GC of a commercially available sclareolide preparation.

"Homofarnesylic acid" (compound (1b)) is equivalent to "(3E,7E)-4,8,12-trimethyltrideca-3,7,11-trienoic acid"

"Sclareolide" (compound (4)) is equivalent to "(3aR,5aS,9aS,9bR)-3a,6,6,9a-tetramethyl-1,4,5,5a,7,8,9,9b-octahydrobenzo[e]benzofuran-2-one".

Laevorotatory sclareolide (or compound (−)-4) has the following formula:

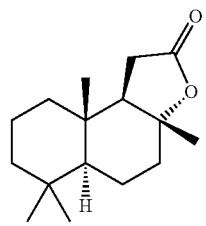

"Ambrox", "Ambroxan" and "Amroxide" are used synonymously herein. They comprise all stereoisomeric forms such as, in particular, (+)-Ambrox, 3a-epi-(−)Ambrox, 9b-epi-(−) Ambrox and in particular (−) Ambrox.

For the purposes of the present invention, "cyclases" are generally enzymes or enzyme mutants which display in particular the activity of a homofarnesylic acid cyclase. Suitable enzymes with the activity of a homofarnesylic acid cyclase are intermolecular transferases from the subclass of the isomerases; that is to say proteins with the EC number EC 5.4 (enzyme code as per Eur. J. Biochem. 1999, 264, 610-650). They are, in particular, representations of EC 5.4.99.17. Suitable enzymes with the activity of a homofarnesylic acid cyclase are in particular those cyclases which also bring about the cyclization of homofarnesylic acid to sclareolide and/or of squalene to hopene (therefore also occasionally the name "SHC" squalene-hopene cyclase) and which are described in detail in the international application PCT/EP2010/057696, which is expressly referred to here. Mutants thereof are described for example in WO 2012/066059, which is expressly referred to here.

Owing to the reversibility of enzymatic reactions, the present invention relates to the enzymatic reactions described herein, in both directions of reaction.

"Functional mutants" of a "cyclase" comprise the "functional equivalents" of such enzymes defined herein below.

The term "biocatalytic process" relates to any process carried out in the presence of catalytic activity of a "cyclase" according to the invention or of an enzyme with "cyclase activity", i.e. processes in the presence of crude, or purified, dissolved, dispersed or immobilized enzyme, or in the presence of intact microbial cells which have or express such an enzymatic activity. Thus, biocatalytic processes comprise enzymatic and microbial processes.

The term "stereoisomers" comprises conformational isomers and in particular configurational isomers, such as enantiomers and diastereoisomers.

Generally also encompassed are, in accordance with the invention, all stereoisomeric forms of the compounds described herein, such as constitutional isomers and in particular stereoisomers and mixed stereoisomers, such as, for example, optical isomers or geometric isomers such as E and Z isomers, and combinations of these. If a plurality of asymmetric centers are present in a molecule, then the invention comprises all combinations of different conformations of these asymmetric centers, such as, for example, enantiomer pairs.

The term "stereospecific" means that one of several possible stereoisomers of a compound with at least one asymmetric center, prepared in accordance with the invention, is, as the result of the activity of an enzyme according to the invention, produced in high "enantiomeric excess" or high "enantiomeric purity", such as, for example, at least 90% ee, in particular at least 95% ee, or at least 98% ee, or at least 99% ee. The ee % value is calculated using the following formula:

ee %=[$X_A$-$X_B$]/[$X_A$+$X_R$]*100, wherein $X_A$ and $X_B$ are the molar fraction of the enantiomers A and B, respectively.

A "cyclase activity", which has been determined on a "reference substrate under standard conditions", is, for example, an enzymatic activity which describes the formation of a cyclic product from a noncyclic substrate. Examples of standard conditions are substrate concentrations of from 10 mM to 0.2 M, in particular 15 to 100 mM, such as, for example, approximately 20 to 25 mM; at a pH 4 to 8, and at temperatures of, for example, from 15 to 30 or 20 to 25° C. Here, the determination can be carried out using recombinant cyclase-expressing cells, disrupted cyclase-expressing cells, fractions thereof or enriched or purified cyclase enzyme. A reference substrate is, in particular, a homofarnesylic acid of the formula (Ia); standard conditions are in particular approximately 20 to 25 mM of homofarnesylic acid of the formula (Ia), at 20 to 25° C. and pH 4-6, such as 4.5; as also described in more detail in the examples.

The "yield" and/or the "conversion" of a reaction according to the invention is determined over a defined period of, for example, 4, 6, 8, 10, 12, 16, 20, 24, 36 or 48 hours, during which homofarnesylic acid is converted into sclareolide by means of cyclases according to the invention. In particular, the conversion is carried out under precisely defined conditions of, for example, 25, 30, 40, 50 or 60° C. In particular, the yield and/or the conversion is determined by carrying out the reaction for converting homofarnesylic acid into sclareolide by means of the cyclases according to the invention at 30° C. over 16 hours.

To determine the yield and/or the conversion, one will, in particular, react a 10 mM homofarnesylic acid solution with a cyclase solution, the enzyme being present as membrane protein extract cyclase-expressing cells (isolated for example as described by [Ochs D. et al.; *J. Bacteriol*, (1992), 174: 298]) in a protein content concentration of 0.08 percent by weight.

A cyclase according to the invention may also be characterized in that, when homofarnesylic acid is converted to sclareolide under identical conditions, it shows the 2-, 3-, 4-, 5-, 6-, 7-, 8-, 9-, 10-, 11-, 12-, 13-, 14-, 15-, 16-, 17-, 18-, 19-, 20-, 21-, 22-, 23-, 24-, 25-, 26-, 27-, 28-, 29-, 30-, 31-, 32-, 33-, 34-, 35-, 36-, 37-, 38-, 39-, 40-, 41-, 42-, 43-, 44-, 45-, 46-, 47-, 48-, 49-, 50-, 51-, 52-, 53-, 54-, 55-, 56-, 57-, 58-, 59-, 60-, 61-, 62-, 63-, 64-, 65-, 66-, 67-, 68-, 69-, 70-, 71-, 72-, 73-, 74-, 75-, 76-, 77-, 78-, 79-, 80-, 81-, 82-, 83-, 84-, 85-, 86-, 87-, 88-, 89-, 90-, 91-, 92-, 93-, 94-, 95-, 96-, 97-, 98-, 99-, 100-, 200-, 500-, 1000-fold or higher yield and/or conversion in comparison with the squalene-hopene cyclase (SHC) from *Alicyclobacillus acidocaldarius* (formerly *Bacillus acidocaldarius*). Here, the term "conditions" refers to reaction conditions such as substrate concentration, enzyme concentration, reaction period and/or temperature.

The term "carboxylic acid" comprises both the free acid and its salt form, such as, for example, its alkali or alkaline-earth metal salts. This applies analogously to all carboxylic acids mentioned herein, such as, for example, homofarnesylic acid.

The term "approximately" denotes a potential change of ±25% of a stated value, especially ±15%, ±10%, preferably ±5%, ±2 or ±1%.

The term "essentially" spans a range of values of approximately 80% up to and including 100%, such as 85-99.9%, especially 90 to 99.9%, preferably 95 to 99.9% or 98 to 99.9%, in particular 99 to 99.9%.

Unless otherwise indicated, the following general chemical definitions apply herein:

"Alkyl" represents saturated, straight-chain or branched, in particular straight-chain hydrocarbon radicals with 1 to 6, in particular 1 to 4, carbon atoms, for example methyl, ethyl, propyl, 1-methylethyl, butyl, 1-methylpropyl, 2-methylpropyl, and 1,1-dimethylethyl as examples of representatives of $C_1$-$C_4$-alkyl; and pentyl, 1-methylbutyl, 2-methylbutyl, 3-methylbutyl, 2,2-dimethylpropyl, 1-ethylpropyl, hexyl, 1,1-dimethylpropyl, 1,2-dimethylpropyl, 1-methylpentyl, 2-methylpentyl, 3-methylpentyl, 4-methylpentyl, 1,1-dimethylbutyl, 1,2-dimethylbutyl, 1,3-dimethylbutyl, 2,2-dimethylbutyl, 2,3-dimethylbutyl, 3,3-dimethylbutyl, 1-ethylbutyl, 2-ethylbutyl, 1,1,2-trimethylpropyl, 1,2,2-trimethylpropyl, 1-ethyl-1-methylpropyl and 1-ethyl-2-methylpropyl and in particular methyl, ethyl, n-propyl and n-butyl.

B. Specific Embodiments of the Invention

The present invention particularly relates to the following specific embodiments:

1. A process for the biocatalytic preparation of a compound of the general formula II,

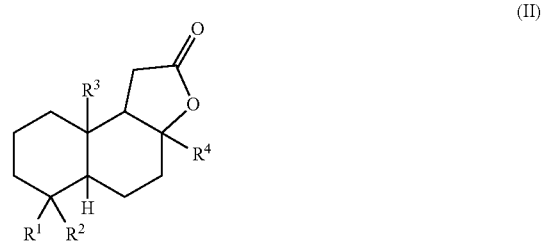

wherein $R^1$, $R^2$, $R^3$ and $R^4$ independently of one another represent H or $C_1$-$C_4$-alkyl, in particular methyl or ethyl, preferably methyl, in stereoisomerically pure form or as a mixture of stereoisomers, wherein the compound is brought into contact with a protein, in particular a protein with cyclase activity, which protein is capable of cyclizing a polyunsaturated carboxylic acid, in particular homofarnesylic acid.

2. The process as per embodiment 1, wherein the compound of the formula I is brought into contact with a protein which has the enzymatic activity of a squalene-hopene cyclase (SHC).

3. The process as per embodiment 1 or 2, wherein the substrate employed is a polyunsaturated carboxylic acid of the general formula I

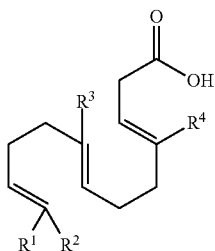

(I)

wherein $R^1$, $R^2$, $R^3$ and $R^4$ have the abovementioned meanings, in particular in essentially stereoisomer-pure form.

4. The process as per any of the preceding embodiments, wherein homofarnesylic acid, of the formula Ia,

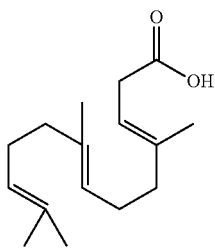

(Ia)

is employed as the starting material, in particular in essentially stereoisomerically pure form, preferably in a proportion of (3E,7E)-homofarnesylic acid of at least 70 mol %, particularly preferably at least 75, 80 or 85 mol %, most preferably 90, 95 or 99 or 99.9 mol %, based on the total amount of homofarnesylic acid isomers present.

5. The process as per embodiment 4, wherein sclareolide, of the formula IIa,

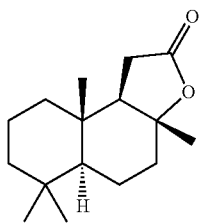

(IIa)

is obtained in stereoisomerically pure form or as a mixture of stereoisomers.

6. The process as per any of the preceding embodiments, wherein the SHC is selected from among
   a) proteins comprising a polypeptide with an amino acid sequence as per SEQ ID NO: 2,
   b) by deletion, insertion, substitution, addition, inversion or a combination of proteins derived as per a), comprising a polypeptide with a sequence identity of at least 45%, 50%, 55%, 60%, 65%, 70%, in particular at least 75% or 80%, preferably at least 85%, such as, for example, at least 90, 91, 92, 93, 94, 95, 96, 97, 98 or 99%, to the amino acid sequence as per SEQ ID NO: 2; and
   c) proteins which are functionally equivalent to a) or b) and which catalyze the cyclization of homofarnesylic acid to sclareolide.

7. The process as per embodiment 6, wherein the functionally equivalent protein comprises a polypeptide with an amino acid sequence which is selected from among
   a) SEQ ID NO: 3 to 326 and
   b) an amino acid sequence which is derived therefrom by deletion, insertion, substitution, addition, inversion or a combination and which has a degree of identity of at least 60%, 65%, 70%, particularly at least 75% or 80%, preferably at least 85%, such as, for example, at least 90, 91, 92, 93, 94, 95, 96, 97, 98 or 99%.

8. The process as per any of the preceding embodiments, wherein the enzymatic cyclase activity, in particular the activity of the SHC, is present in a form selected from among:
   a) a free, optionally partially or fully purified natural or recombinantly produced cyclase,
   b) cyclase as per a) in immobilized form;
   c) intact cells, comprising at least one cyclase;
   d) cell lysates or cell homogenates of cells as per c).

9. The process as per any of the preceding embodiments, wherein the conversion is carried out in one-phase aqueous systems or in two-phase aqueous-organic or solid-liquid systems.

10. The process as per any of the preceding embodiments, wherein the conversion is carried out at a temperature in the range from 0 to 60° C., in particular from 10 to 50° C., preferably from 20 to 40° C. and/or a pH value in the range of from 4 to 8, in particular from 5 to 7.

11. The process as per any of the preceding embodiments, wherein the SHC is isolated from a microorganism selected among *Methylococcus capsalatus*, *Rhodopseudomonas palustris*, *Bradyrhizobium japonicum*, *Frankia* spec., *Streptomyces coelicolor* and in particular *Zymomonas mobilis*.

12. The process as per any of the preceding embodiments, wherein the SHC is isolated from an SHC-overexpressing microorganism which is selected among bacteria of the genus *Escherichia*, *Corynebacterium*, *Ralstonia*, *Clostridium*, *Pseudomonas*, *Bacillus*, *Zymomonas*, *Rhodobacter*, *Streptomyces*, *Burkholderia*, *Lactobacillus* and *Lactococcus*.

13. The process as per any of the preceding embodiments, wherein the SHC is isolated from transgenic SHC-overexpressing bacteria of the species *Escherichia coli*, *Pseudomonas putida*, *Burkholderia glumae*, *Streptomyces lividans*, *Streptomyces coelicolor* and *Zymomonas mobilis*.

14. The process as per any of the preceding embodiments, wherein the conversion is carried out in batch mode, fed-batch mode or continuous mode.

15. The process as per any of the preceding embodiments, wherein the biocatalytic conversion is carried out under at least one of the following conditions:
   a) at a pH value of the reaction medium in the range from approximately 4 to 5.9 or 5.8 or 4.5 to 5.8, in particular 4.5 to 5.5 or 5 to 5.5;
   b) at a substrate concentration of at least 15 mM, such as, for example, up to 100 mM, in particular up to 50 mM, in particular 15 to 30 mM, above all 15 to 25 mM;
   c) at an enzyme concentration of at least 5 mg/ml; in particular 5 to 100, preferably 10 to 50 or 15 to 40 or 15 to 30 mg/ml
   d) at a reaction temperature in the range from 32 to 40° C., in particular 35 to 38° C.;

e) in a citrate buffer, in particular sodium citrate buffer, in particular comprising 1 to 20 mM or 5 to 10 mM $MgCl_2$
f) at a buffer concentration of approximately 10 to 100, in particular 20 to 50 mM.

The processes according to the invention are carried out preferably with simultaneous realization of the above conditions a) to b) or a) to c) or a) to d) or a) to e) or a) to f). Here, any combinations of parameter ranges, independently of the respective degree of preference of individual ranges, are part of the present disclosure.

16. The process for the preparation of 3a,6,6,9a-tetramethyldodecahydronaphtho[2,1-b]furan (ambroxide), wherein
a) homofarnesylic acid is converted into sclareolide by a process as per any of claims 1 to 13;
b) the product of step a) is reduced chemically in a manner known per se to ambroxdiol, and
c) ambroxidol from step b) is cyclized chemically in a manner known per se to ambroxide.

17. Process as per embodiment 16, wherein ambroxide is (−)-ambroxide ((3aR,5aS,9aS,9bR)-3a,6,6,9a-tetramethyldodecahydronaphtho[2,1-b]furan [CAS 6790-58-5]).

C. Further Embodiments of the Invention

1. Particularly Suitable Cyclase Sequences

Cyclases which are useful in accordance with the invention are SHCs whose SEQ ID NO for the corresponding wild-type sequence, source organism and Genbank reference number are compiled in the following table.

| S_ID DB | SEQ ID NO | Organism | GI No. of the reference sequences |
|---|---|---|---|
| s1 | seq_ID 2 | *Zymomonas mobilis* | AAV90172.1 |
| s20 | seq_ID 3 | *Streptomyces coelicolor* | CAB39697.1 |
| s911 | seq_ID 4 | *Acetobacter pasteurianus* | BAH99456.1 |
| s2 | seq_ID 5 | *Bradyrhizobium sp.* | ABQ33590.1 |
| s940 | seq_ID 6 | *Zymomonas mobilis* | EER62728.1 |
| s949 | seq_ID 7 | *Acidithiobacillus caldus* | EET25937.1 |
| s167 | seq_ID 8 | *Acidithiobacillus ferrooxidans* | ACH84004.1 |
| s41 | seq_ID 9 | *Acidobacterium capsulatum* | ACO34244.1 |
| s36 | seq_ID 10 | *Acidothermus cellulolyticus* | ABK53469.1 |
| s83 | seq_ID 11 | *Adiantum capillus-veneris* | BAF93209.1 |
| s143 | seq_ID 12 | *Ajellomyces capsulatus* | EDN09769.1 |
| s995 | seq_ID 13 | *Ajellomyces capsulatus* | EER40510.1 |
| s163 | seq_ID 14 | *Ajellomyces capsulatus* | EEH02950.1 |
| s13 | seq_ID 15 | *Alicyclobacillus acidocaldarius* | EED08231.1 |
| s14 | seq_ID 16 | *Alicyclobacillus acidocaldarius* | P33247.4 |
| s1193 | seq_ID 17 | *Alicyclobacillus acidocaldarius* | AAT70690.1 |
| s21 | seq_ID 18 | *Alicyclobacillus acidoterrestris* | CAA61950.1 |
| s1189 | seq_ID 19 | *Alicyclobacillus acidoterrestris* | AAT70691.1 |
| s51 | seq_ID 20 | *Anabaena variabilis* | ABA24268.1 |
| s76 | seq_ID 21 | *Anaeromyxobacter sp.* | ABS28257.1 |
| s159 | seq_ID 22 | *Aspergillus clavatus* | EAW07713.1 |
| s131 | seq_ID 23 | *Aspergillus flavus* | EED48353.1 |
| s176 | seq_ID 24 | *Aspergillus fumigatus* | EDP50814.1 |
| s126 | seq_ID 25 | *Aspergillus fumigatus* | EAL84865.1 |
| s178 | seq_ID 26 | *Aspergillus fumigatus* | EAL86291.2 |
| s121 | seq_ID 27 | *Aspergillus niger* | CAK43501.1 |
| s115 | seq_ID 28 | *Aspergillus niger* | CAK45506.1 |
| s124 | seq_ID 29 | *Aspergillus oryzae* | BAE63941.1 |
| s119 | seq_ID 30 | *Azotobacter vinelandii* | EAM07611.1 |
| s223 | seq_ID 31 | *Bacillus amyloliquefaciens* | ABS74269.1 |
| s221 | seq_ID 32 | *Bacillus anthracis* | AAP27368.1 |
| s976 | seq_ID 33 | *Bacillus cereus* | EEK66523.1 |
| s225 | seq_ID 34 | *Bacillus cereus* | EAL12758.1 |
| s972 | seq_ID 35 | *Bacillus cereus* | EEL44583.1 |
| s977 | seq_ID 36 | *Bacillus cereus* | EEK43841.1 |
| s985 | seq_ID 37 | *Bacillus cereus* | EEK82938.1 |
| s988 | seq_ID 38 | *Bacillus cereus* | EEK99528.1 |
| s981 | seq_ID 39 | *Bacillus cereus* | EEK77935.1 |
| s987 | seq_ID 40 | *Bacillus cereus* | EEL81079.1 |
| s960 | seq_ID 41 | *Bacillus cereus* | EEK88307.1 |
| s979 | seq_ID 42 | *Bacillus cereus* | EEL63943.1 |
| s974 | seq_ID 43 | *Bacillus cereus* | EEL59884.1 |
| s956 | seq_ID 44 | *Bacillus cereus* | EEL69857.1 |
| s951 | seq_ID 45 | *Bacillus cereus* | EEL92663.1 |
| s986 | seq_ID 46 | *Bacillus cereus* | EEL49968.1 |
| s227 | seq_ID 47 | *Bacillus cereus* | AAU16998.1 |
| s224 | seq_ID 48 | *Bacillus cereus* | AAS42477.1 |
| s212 | seq_ID 49 | *Bacillus cereus* | ACK95843.1 |
| s289 | seq_ID 50 | *Bacillus coahuilensis* | 205373680 |
| s219 | seq_ID 51 | *Bacillus cytotoxicus* | ABS22481.1 |
| s230 | seq_ID 52 | *Bacillus licheniformis* | AAU23777.1 |
| s955 | seq_ID 53 | *Bacillus mycoides* | EEL98438.1 |
| s990 | seq_ID 54 | *Bacillus mycoides* | EEM04821.1 |
| s989 | seq_ID 55 | *Bacillus pseudomycoides* | EEM16144.1 |
| s247 | seq_ID 56 | *Bacillus pumilus* | ABV62529.1 |
| s250 | seq_ID 57 | *Bacillus pumilus* | EDW21137.1 |
| s249 | seq_ID 58 | *Bacillus sp.* | EAR64404.1 |
| s218 | seq_ID 59 | *Bacillus sp.* | EDL66148.1 |
| s241 | seq_ID 60 | *Bacillus subtilis* | Q796C3.1 |
| s284 | seq_ID 61 | *Bacillus subtilis* | AAB84441.1 |
| s215 | seq_ID 62 | *Bacillus thuringiensis* | ABK86448.1 |
| s984 | seq_ID 63 | *Bacillus thuringiensis* | EEM21409.1 |
| s957 | seq_ID 64 | *Bacillus thuringiensis* | EEM82653.1 |
| s980 | seq_ID 65 | *Bacillus thuringiensis* | EEM52372.1 |
| s961 | seq_ID 66 | *Bacillus thuringiensis* | EEM27851.1 |
| s969 | seq_ID 67 | *Bacillus thuringiensis* | EEM40716.1 |
| s959 | seq_ID 68 | *Bacillus thuringiensis* | EEM46814.1 |
| s965 | seq_ID 69 | *Bacillus thuringiensis* | EEM94969.1 |
| s202 | seq_ID 70 | *Bacillus weihenstephanensis* | ABY44436.1 |
| s63 | seq_ID 71 | *Bacterium Ellin514* | EEF57225.1 |
| s72 | seq_ID 72 | *Bacterium Ellin514* | EEF59508.1 |
| s87 | seq_ID 73 | *Beijerinckia indica* | ACB96717.1 |
| s69 | seq_ID 74 | *Blastopirellula marina* | EAQ81955.1 |
| s543 | seq_ID 75 | *Blastopirellula marina* | EAQ78122.1 |
| s156 | seq_ID 76 | *Bradyrhizobium japonicum* | CAA60250.1 |
| s938 | seq_ID 77 | *Acetobacter pasteurianus* | BAH98349.1 |
| s3 | seq_ID 78 | *Bradyrhizobium sp.* | CAL79893.1 |
| s201 | seq_ID 79 | *Brevibacillus brevis* | BAH44778.1 |
| s148 | seq_ID 80 | *Burkholderia ambifaria* | EDT05097.1 |
| s158 | seq_ID 81 | *Burkholderia ambifaria* | EDT37649.1 |
| s149 | seq_ID 82 | *Burkholderia ambifaria* | ACB63303.1 |
| s100 | seq_ID 83 | *Burkholderia ambifaria* | EDT42454.1 |
| s146 | seq_ID 84 | *Burkholderia cenocepacia* | EAY66961.1 |
| s139 | seq_ID 85 | *Burkholderia cenocepacia* | ACA95661.1 |
| s147 | seq_ID 86 | *Burkholderia cenocepacia* | CAR57099.1 |
| s95 | seq_ID 87 | *Burkholderia cenocepacia* | CAR56694.1 |
| s102 | seq_ID 88 | *Burkholderia dolosa* | EAY71311.1 |
| s941 | seq_ID 89 | *Burkholderia glumae* | ACR32572.1 |
| s945 | seq_ID 90 | *Burkholderia glumae* | ACR30752.1 |
| s132 | seq_ID 91 | *Burkholderia graminis* | EDT12320.1 |
| s104 | seq_ID 92 | *Burkholderia mallei* | ABM48844.1 |
| s140 | seq_ID 93 | *Burkholderia multivorans* | ABX19650.1 |
| s116 | seq_ID 94 | *Burkholderia multivorans* | ABX16859.1 |
| s91 | seq_ID 95 | *Burkholderia oklahomensis* | 167567074 |
| s111 | seq_ID 96 | *Burkholdoria phymatum* | ACC73258.1 |
| s127 | seq_ID 97 | *Burkholderia phytofirmans* | ACD21317.1 |
| s120 | seq_ID 98 | *Burkholderia pseudomallei* | EEC32728.1 |
| s137 | seq_ID 99 | *Burkholderia sp.* | EEA03553.1 |
| s144 | seq_ID 100 | *Burkholderia sp.* | ABB06563.1 |
| s98 | seq_ID 101 | *Burkholderia sp.* | ABB10136.1 |
| s944 | seq_ID 102 | *Burkholderia sp. CCGE1002* | EFA54357.1 |
| s89 | seq_ID 103 | *Burkholderia thailandensis* | 167840988 |
| s113 | seq_ID 104 | *Burkholderia thailandensis* | 167617352 |
| s154 | seq_ID 105 | *Burkholderia ubonensis* | 167589807 |
| s93 | seq_ID 106 | *Burkholderia ubonensis* | 167584986 |
| s96 | seq_ID 107 | *Burkholderia vietnamiensis* | ABO56791.1 |
| s150 | seq_ID 108 | *Burkholderia xenovorans* | ABE35912.1 |
| s54 | seq_ID 109 | *Candidates Koribacter* | ABF40741.1 |
| s171 | seq_ID 110 | *Candidates Kuenenia* | CAJ71215.1 |

| S_ID DB | SEQ ID NO | Organism | GI No. of the reference sequences |
|---|---|---|---|
| s79 | seq_ID 111 | Candidates Solibacter | ABJ82180.1 |
| s99 | seq_ID 112 | Candidates Solibacter | ABJ82254.1 |
| s917 | seq_ID 113 | Catenulispora acidiphila | ACU75510.1 |
| s65 | seq_ID 114 | Chthoniobacter flavus | EDY15838.1 |
| s637 | seq_ID 115 | Chthoniobacter flavus | EDY22035.1 |
| s38 | seq_ID 116 | Crocosphaera watsonii | EAM53094.1 |
| s186 | seq_ID 117 | Cupriavidus taiwanensis | CAQ72562.1 |
| s32 | seq_ID 118 | Cyanothece sp. | ACB53858.1 |
| s40 | seq_ID 119 | Cyanothece sp. | ACK71719.1 |
| s30 | seq_ID 120 | Cyanothece sp. | EDY02410.1 |
| s29 | seq_ID 121 | Cyanothece sp. | ACK66841.1 |
| s47 | seq_ID 122 | Cyanothece sp. | EDX97382.1 |
| s35 | seq_ID 123 | Cyanothece sp. | EAZ91809.1 |
| s39 | seq_ID 124 | Cyanothece sp. | ACL45896.1 |
| s925 | seq_ID 125 | Cyanothece sp. PCC 8802 | ACV02092.1 |
| s64 | seq_ID 126 | Desulfovibrio salexigens | EEC62384.1 |
| s74 | seq_ID 127 | Dryopteris crassirhizoma | BAG68223.1 |
| s59 | seq_ID 128 | Frankia alni | CAJ61140.1 |
| s48 | seq_ID 129 | Frankia alni | CAJ60090.1 |
| s56 | seq_ID 130 | Frankia sp. | ABD10207.1 |
| s60 | seq_ID 131 | Frankia sp. | ABW15063.1 |
| s31 | seq_ID 132 | Frankia sp. | ABW14125.1 |
| s948 | seq_ID 133 | Frankia sp. EuI1c | EFA59873.1 |
| s919 | seq_ID 134 | Frankia sp. EuI1c | EFA59089.1 |
| s628 | seq_ID 135 | Gemmata obscuriglobus | 168700710 |
| s209 | seq_ID 136 | Geobacillus sp. | EED61885.1 |
| s206 | seq_ID 137 | Geobacillus sp. | EDY05760.1 |
| s964 | seq_ID 138 | Geobacillus sp. Y412MC52 | EEN95021.1 |
| s993 | seq_ID 139 | Geobacillus sp. Y412MC61 | ACX79399.1 |
| s205 | seq_ID 140 | Geobacillus thermodenitrificans | ABO67242.1 |
| s15 | seq_ID 141 | Geobacter bemidjiensis | ACH40355.1 |
| s8 | seq_ID 142 | Geobacter lovleyi | ACD95949.1 |
| s62 | seq_ID 143 | Geobacter metallireducens | ABB30662.1 |
| s12 | seq_ID 144 | Geobacter metallireducens | ABB33038.1 |
| s73 | seq_ID 145 | Geobacter sp. | ACM21577.1 |
| s10 | seq_ID 146 | Geobacter sp. | EDV72707.1 |
| s11 | seq_ID 147 | Geobacter sp. | ACM22003.1 |
| s913 | seq_ID 148 | Geobacter sp. M18 | EET34621.1 |
| s914 | seq_ID 149 | Geobacter sp. M21 | ACT16952.1 |
| s58 | seq_ID 150 | Geobacter sulfurreducens | AAR36453.1 |
| s7 | seq_ID 151 | Geobacter sulfurreducens | AAR34018.1 |
| s9 | seq_ID 152 | Geobacter uraniireducens | ABQ25226.1 |
| s46 | seq_ID 153 | Cloeobacter violaceus | BAC91998.1 |
| s67 | seq_ID 154 | Gluconacetobacter diazotrophicus | ACI51585.1 |
| s165 | seq_ID 155 | Gluconacetobacter diazotrophicus | CAP55563.1 |
| s68 | seq_ID 156 | Gluconobacter oxydans | AAW61994.1 |
| s80 | seq_ID 157 | Granulibacter bethesdensis | ABI63005.1 |
| s937 | seq_ID 158 | Hyphomicrobium denitrificans | EET65847.1 |
| s932 | seq_ID 159 | Leptospirillum ferrodiazotrophum | EES53667.1 |
| s24 | seq_ID 160 | Leptospirillum rubarum | EAY57382.1 |
| s25 | seq_ID 161 | Leptospirillum sp. | EDZ38599.1 |
| s174 | seq_ID 162 | Magnaporthe grisea | EDK02551.1 |
| s153 | seq_ID 163 | Magnetospirillum magnetotacticum | 46203107 |
| s49 | seq_ID 164 | Methylacidiphilum infernorum | ACD82457.1 |
| s169 | seq_ID 165 | Methylobacterium chloromethanicum | ACK83067.1 |
| s75 | seq_ID 166 | Methylobacterium chloromethanicum | ACK86232.1 |
| s946 | seq_ID 167 | Methylobacterium extorquens | CAX24364.1 |
| s141 | seq_ID 168 | Methylobacterium nodulans | ACL61886.1 |
| s152 | seq_ID 169 | Methylobacterium populi | ACB79998.1 |
| s162 | seq_ID 170 | Methylobacterium radiotolerans | ACB27373.1 |
| ε180 | εeq_ID 171 | Methylobacterium sp. | ACA20611.1 |
| s175 | seq_ID 172 | Methylocella silvestris | ACK52150.1 |
| s181 | seq_ID 173 | Methylococcus capsulatus | CAA71098.1 |
| s55 | seq_ID 174 | Microcystis aeruginosa | CAO86472.1 |
| s101 | seq_ID 175 | Neosartorya fischeri | EAW20752.1 |
| s129 | seq_ID 176 | Nitrobacter hamburgensis | ABE63461.1 |
| s161 | seq_ID 177 | Nitrobacter sp. | EAQ34404.1 |
| s160 | seq_ID 178 | Nitrobacter winogradskyi | ABA05523.1 |
| s157 | seq_ID 179 | Nitrococcus mobilis | EAR22397.1 |
| s164 | seq_ID 180 | Nitrosococcus oceani | ABA57818.1 |
| s170 | seq_ID 181 | Nitrosomonas europaea | CAD85079.1 |
| s173 | seq_ID 182 | Nitrosomonas eutropha | ABI59752.I |
| s943 | seq_ID 183 | Nitrosomonas sp. AL212 | EET32702.1 |
| s142 | seq_ID 184 | Nitrosospira multiformis | ABB75845.1 |
| s52 | seq_ID 185 | Nostoc punctiforme | ACC84529.1 |
| s45 | seq_ID 186 | Nostoc sp. | BAB72732.1 |
| s122 | seq_ID 187 | Oligotropha carboxidovorans | ACI93782.1 |
| s233 | seq_ID 188 | Paenibacillus sp. | EDS49994.1 |
| s991 | seq_ID 189 | Paenibacillus sp. JDR-2 | ACS99948.1 |
| s950 | seq_ID 190 | Paenibacillus sp. oral taxon 786 | EES74793.1 |
| s1280 | seq_ID 191 | Paramecium tetraurelia | 145542269 |
| s71 | seq_ID 192 | Pelobacter carbinolicus | ABA87701.1 |
| s5 | seq_ID 193 | Pelobacter carbinolicus | ABA87615.1 |
| s66 | seq_ID 194 | Pelobacter propionicus | ABK98395.1 |
| s16 | seq_ID 195 | Pelobacter propionicus | ABK98811.1 |
| s136 | seq_ID 196 | Penicillium chrysogenum | CAP99707.1 |
| s936 | seq_ID 197 | Planctomyces limnophilus | EEO67214.1 |
| s1158 | seq_ID 198 | Planctomyces limnophilus | EEO68341.1 |
| s526 | seq_ID 199 | Planctomyces maris | EDL58855.1 |
| s992 | seq_ID 200 | Polypodiodes niponica | BAI48071.1 |
| s942 | seq_ID 201 | Polypodiodes niponica | BAI48070.1 |
| s1202 | seq_ID 202 | Populus trichocarpa | EEF12098.1 |
| s168 | seq_ID 203 | Ralstonia eutropha | AAZ64302.1 |
| s190 | seq_ID 204 | Ralstonia eutropha | CAJ96989.1 |
| s81 | seq_ID 205 | Ralstonia metallidurans | ABF11015.1 |
| s110 | seq_ID 206 | Ralstonia metallidurans | ABF11268.1 |
| s123 | seq_ID 207 | Rhizobium sp. | P55348.1 |
| s657 | seq_ID 208 | Rhodopirellula baltica | CAD74517.1 |
| s4 | seq_ID 209 | Rhodopseudomonas palustris | ABJ08391.1 |
| ε130 | seq_ID 210 | Rhodopseudomonas palustris | CAA71101 1 |
| s155 | seq_ID 211 | Rhodopseudomonas palustris | ABD06434.1 |
| s97 | seq_ID 212 | Rhodopseudomonas palustris | ABD87279.1 |
| s135 | seq_ID 213 | Rhodopseudomonas palustris | ACF02757.1 |
| s84 | seq_ID 214 | Rhodospirillum rubrum | ABC20867.1 |
| s1279 | seq_ID 215 | Rubrobacter xylanophilus | ABG05671.1 |
| s915 | seq_ID 216 | Saccharomonospora viridis | ACU97316.1 |
| s42 | seq_ID 217 | Saccharopolyspora erythraea | CAM03596.1 |
| s82 | seq_ID 218 | Schizosaccharomyces japonicus | EEB08219.1 |
| s923 | seq_ID 219 | Sphaerobacter thermophilus | ACZ39437.1 |
| s924 | seq_ID 220 | Streptomyces albus | 239983547 |
| s23 | seq_ID 221 | Streptomyces avermitilis | BAC69361.1 |
| s44 | seq_ID 222 | Acaryochloris marina | ABW29816.1 |
| s921 | seq_ID 223 | Streptomyces filamentosus | 239945642 |
| s934 | seq_ID 224 | Streptomyces flavogriseus | EEW70811.1 |
| s920 | seq_ID 225 | Streptomyces ghanaensis | 239927462 |
| s922 | seq_ID 226 | Streptomyces griseoflavus | 256812310 |
| s28 | seq_ID 227 | Streptomyces griseus | BAG17791.1 |
| s926 | seq_ID 228 | Streptomyces hygroscopicus | 256775136 |
| s916 | seq_ID 229 | Streptomyces lividans | 256783789 |
| s33 | seq_ID 230 | Streptomyces peucetius | ACA52082.1 |
| s27 | seq_ID 231 | Streptomyces pristinaespiralis | EDY61772.1 |
| s933 | seq_ID 232 | Streptomyces scabiei | CBG68454.1 |
| s37 | seq_ID 233 | Streptomyces sp. | EDX25760.1 |
| s34 | seq_ID 234 | Streptomyces sp. | EDY46371.1 |
| s931 | seq_ID 235 | Streptomyces sp. AA4 | 256668250 |
| s918 | seq_ID 236 | Streptomyces sp. C | 256770952 |
| s929 | seq_ID 237 | Streptomyces sp. Mg1 | 254385931 |
| s928 | seq_ID 238 | Streptomyces sp. SPB74 | 254379682 |
| s930 | seq_ID 239 | Streptomyces sp. SPB78 | 256680470 |
| s26 | seq_ID 240 | Streptomyces sviceus | EDY55942.1 |
| s927 | seq_ID 241 | Streptomyces viridochromogenes | 256805984 |
| s61 | seq_ID 242 | Synechococcus sp. | EDX84551.1 |
| s935 | seq_ID 243 | Synechococcus sp. PCC 7335 | 254422098 |
| s53 | seq_ID 244 | Synechocystis sp. | BAA17978.1 |
| s22 | seq_ID 245 | Syntrophobacter fumaroxidans | ABK18414.1 |

| S_ID DB | SEQ ID NO | Organism | GI No. of the reference sequences |
|---|---|---|---|
| s6 | seq_ID 246 | Syntrophobacter fumaroxidans | ABK17672.1 |
| s912 | seq_ID 247 | Teredinibacter turnerae | ACR13362.1 |
| s57 | seq_ID 248 | Thermosynechococcus elongatus | BAC09861.1 |
| s43 | seq_ID 249 | Trichodesmium erythraeum | ABG50159.1 |
| s1178 | seq_ID 250 | Uncultured organism | ACA58560.1 |
| s1176 | seq_ID 251 | Uncultured organism | ABL07557.1 |
| s1165 | seq_ID 252 | Uncultured organism | ACA58559.1 |
| s1166 | seq_ID 253 | Uncultured organism | ACA58558.1 |
| s1168 | seq_ID 254 | Uncultured organism | ABL07560.1 |
| s1169 | seq_ID 255 | Uncultured organism | ABL07565.1 |
| s1170 | seq_ID 256 | Uncultured organism | ABL07566.1 |
| s1167 | seq_ID 257 | Uncultured organism | ACA58545.1 |
| s1171 | seq_ID 258 | Uncultured organism | ACA58535.1 |
| s1180 | seq_ID 259 | Uncultured organism | ACA58549.1 |
| s1179 | seq_ID 260 | Uncultured organism | ACA58554.1 |
| s1181 | seq_ID 261 | Uncultured organism | ACA58555.1 |
| s1182 | seq_ID 262 | Uncultured organism | ACA58556.1 |
| s1235 | seq_ID 263 | Uncultured organism | ACA58530.1 |
| s1188 | seq_ID 264 | Uncultured organism | ACA58534.1 |
| s1237 | seq_ID 265 | Uncultured organism | ACA58552.1 |
| s1223 | seq_ID 266 | Uncultured organism | ABL07558.1 |
| s1200 | seq_ID 267 | Uncultured organism | ABL07542.1 |
| s1236 | seq_ID 268 | Uncultured organism | ACA58539.1 |
| s1238 | seq_ID 269 | Uncultured organism | ACA58537.1 |
| s1233 | seq_ID 270 | Uncultured organism | ACA58543.1 |
| s1173 | seq_ID 271 | Uncultured organism | ABL07553.1 |
| s1241 | seq_ID 272 | Uncultured organism | ABL07540.1 |
| s1242 | seq_ID 273 | Uncultured organism | ABL07544.1 |
| s1225 | seq_ID 274 | Uncultured organism | ACA58557.1 |
| s1183 | seq_ID 275 | Uncultured organism | ACA58520.1 |
| s1197 | seq_ID 276 | Uncultured organism | ACA58524.1 |
| s1185 | seq_ID 277 | Uncultured organism | ACA58522.1 |
| s1190 | seq_ID 278 | Uncultured organism | ACA58525.1 |
| s1187 | seq_ID 279 | Uncultured organism | ACA58523.1 |
| s1184 | seq_ID 280 | Uncultured organism | ACA58521.1 |
| s1204 | seq_ID 281 | Uncultured organism | ACA58547.1 |
| s1221 | seq_ID 282 | Uncultured organism | ACA58544.1 |
| s1198 | seq_ID 283 | Uncultured organism | ACA58546.1 |
| s1226 | seq_ID 284 | Uncultured organism | ACA58527.1 |
| s1227 | seq_ID 285 | Uncultured organism | ABL07537.1 |
| s1232 | seq_ID 286 | Uncultured organism | ACA58510.1 |
| s1230 | seq_ID 287 | Uncultured organism | ACA58538.1 |
| s1229 | seq_ID 288 | Uncultured organism | ACA68642.1 |
| s1231 | seq_ID 289 | Uncultured organism | ACA58540.1 |
| s1207 | seq_ID 290 | Uncultured organism | ABL07564.1 |
| s1212 | seq_ID 291 | Uncultured organism | ABL07563.1 |
| s1208 | seq_ID 292 | Uncultured organism | ABL07562.1 |
| s1209 | seq_ID 293 | Uncultured organism | ABL07559.1 |
| s1214 | seq_ID 294 | Uncultured organism | ABL07556.1 |
| s1216 | seq_ID 295 | Uncultured organism | ACA58528.1 |
| s1219 | seq_ID 296 | Uncultured organism | ACA58536.1 |
| s1192 | seq_ID 297 | Uncultured organism | ABL07533.1 |
| s1195 | seq_ID 298 | Uncultured organism | ABL07536.1 |
| s1174 | seq_ID 299 | Uncultured organism | ABL07545.1 |
| s1186 | seq_ID 300 | Uncultured organism | ABL07548.1 |
| s1196 | seq_ID 301 | Uncultured organism | ACA58561.1 |
| s1172 | seq_ID 302 | Uncultured organism | ABL07555.1 |
| s1194 | seq_ID 303 | Uncultured organism | ABL07541.1 |
| s1211 | seq_ID 304 | Uncultured organism | ABL07554.1 |
| s1220 | seq_ID 305 | Uncultured organism | ABL07547.1 |
| s1203 | seq_ID 306 | Uncultured organism | ABL07550.1 |
| s1199 | seq_ID 307 | Uncultured organism | ABL07551.1 |
| s1228 | seq_ID 308 | Uncultured organism | ACA58509.1 |
| s1201 | seq_ID 309 | Uncultured organism | ACA58514.1 |
| s1205 | seq_ID 310 | Uncultured organism | ABL07543.1 |
| s1206 | seq_ID 311 | Uncultured organism | ABL07534.1 |
| s1177 | seq_ID 312 | Uncultured organism | ABL07546.1 |
| s1210 | seq_ID 313 | Uncultured organism | ABL07535.1 |
| s1175 | seq_ID 314 | Uncultured organism | ABL07552.1 |
| s1191 | seq_ID 315 | Uncultured organism | ABL07549.1 |
| s1222 | seq_ID 316 | Uncultured organism | ACA58553.1 |
| s1244 | seq_ID 317 | Uncultured organism | ABL07539.1 |
| s1213 | seq_ID 318 | Uncultured organism | ACA58532.1 |
| s1239 | seq_ID 319 | Uncultured organism | ACA58548.1 |
| s1215 | seq_ID 320 | Uncultured organism | ABL07561.1 |
| s1240 | seq_ID 321 | Uncultured organism | ACA58533.1 |
| s1234 | seq_ID 322 | Uncultured organism | ABL07538.1 |
| s1224 | seq_ID 323 | Uncultured organism | ACA58541.1 |
| s1217 | seq_ID 324 | Uncultured organism | ACA58529.1 |
| s596 | seq_ID 325 | Verrucomicrobium spinosum | 171910093 |
| s70 | seq_ID 326 | Acidiphilium cryplum | ABQ30890.1 |

SEQ ID NO: 2 is the amino acid sequence of the cyclase which is herein also referred to as Zm-SHC-1.

2. Further Proteins/Enzyme Mutants According to the Invention

The present invention is not limited to the proteins with cyclase activity which are specifically disclosed herein, but, rather, also extends to functional equivalents thereof.

"Functional equivalents" or analogs of the specifically disclosed enzymes, in particular of SEQ ID NO: 2 to 6, are, within the scope of the present invention, polypeptides which differ from them and which still retain the desired biological activity, such as, in particular, cyclase activity.

Thus, for example, "functional equivalents" are understood as meaning enzymes and mutants which, in a used test for "cyclase activity" within the meaning of the invention (i.e. with a reference substrate under standard conditions) have an at least 1%, in particular at least approximately 5 to 10%, such as, for example, at least 10% or at least 20%, such as, for example, at least 50% or 75% or 90%, higher or lower activity of an enzyme comprising an amino acid sequence specifically defined herein (in particular SEQ ID NO: 2 to 6).

The activity data for functional equivalents will, unless otherwise specified, refer herein to activity determinations carried out by means of a reference substrate under standard conditions as defined herein.

The "cyclase activity" within the meaning of the invention can be detected with the aid of various known tests. Without being limited thereto, a test using a reference substrate such as, for example, homofarnesylic acid, under standard conditions as described hereinabove and explained in the experimental part, shall be mentioned.

Furthermore, functional equivalents are stable for example between pH 4 to 11 and advantageously have a pH optimum in a range of from pH 5 to 10, such as, in particular 6.5 to 9.5 or 7 to 8 or approximately at 7.5, and a temperature optimum in the range of from 15° C. to 80° C. or 20° C. to 70° C., such as, for example approximately 30 to 60° C. or approximately 35 to 45° C., such as at 40° C.

In accordance with the invention, "functional equivalents" are in particular also understood as meaning "mutants" which are derived from SEQ ID NO:2 to 326, in particular from SEQ ID NO: 2 to 6, and which display, in at least one sequence position of the abovementioned amino acid sequences, an amino acid other than the specifically mentioned amino acid but still have one of the abovementioned biological activities.

"Functional equivalents" comprise the mutants obtainable by one or more, such as, for example, 1 to 50, 2 to 30, 2 to 15, 4 to 12 or 5 to 10 mutations such as amino acid additions, substitutions, deletions and/or inversions, where the abovementioned modifications may occur in any sequence position as long as they lead to a mutant with the property profile according to the invention. Functional equivalence exists in particular also when the reactivity patterns between mutant and unmodified polypeptide agree in terms of quality, i.e. for example identical substrates are converted at different rates.

Nonlimiting examples of suitable amino acid substitutions are compiled in the following table:

| Original residue | Examples of the substitution |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

"Functional equivalents" in the above sense are also "precursors" of the polypeptides described, and also "functional derivatives" and "salts" of the polypeptides.

"Precursors" here are natural or synthetic precursors of the polypeptides with or without the desired biological activity.

The term "salts" is understood as meaning not only salts of carboxyl groups, but also acid addition salts of amino groups of the protein molecules according to the invention. Salts of carboxyl groups may be prepared in a manner known per se and comprise inorganic salts such as, for example, sodium, calcium, ammonium, iron and zinc salts and salts with organic bases such as, for example, amines such as triethanolamine, arginine, lysine, piperidine and the like. Acid addition salts such as, for example, salts with mineral acids such as hydrochloric acid or sulfuric acid and salts with organic acids such as acetic acid and oxalic acid are likewise subject matter of the invention.

Likewise, "functional derivatives" of polypeptides according to the invention can be prepared on functional amino acid side groups or at their N- or C-terminal ends with the aid of known techniques. Such derivatives comprise, for example, aliphatic esters of carboxylic acid groups, amides of carboxylic acid groups, obtainable by reaction with ammonia or with a primary or secondary amine; N-acyl derivatives of free amino groups, prepared by reaction with acyl groups; or O-acyl derivatives of free hydroxyl groups, prepared by reaction with acyl groups.

Naturally, "functional equivalents" also comprise polypeptides which can be obtained from other organisms, and naturally occurring variants. By means of sequence comparison, for example, areas of homologous sequence regions can be established, and equivalent enzymes can be determined based on the specific information of the invention.

"Functional equivalents" likewise comprise fragments, preferably individual domains or sequence motifs, of the polypeptides according to the invention, which have for example the desired biological function.

"Functional equivalents" are furthermore fusion proteins which have one of the aforementioned polypeptide sequences or functional equivalents derived therefrom and at least one further, functionally different, heterologous sequence in functional N- or C-terminal linkage (i.e. without mutual substantial functional impairment of the fusion protein moieties). Nonlimiting examples of heterologous sequences of this kind are, for example, signal peptides, histidine anchors or enzymes.

"Functional equivalents" which are also comprised in accordance with the invention are homologs to the specifically disclosed proteins. These have at least 60%, preferably at least 75%, in particular at least 85%, such as, for example, 90, 91, 92, 93, 94, 95, 96, 97, 98 or 99%, homology (or identity) to one of the specifically disclosed amino acid sequences, calculated by the algorithm of Pearson and Lipman, Proc. Natl. Acad, Sci. (USA) 85(8), 1988, 2444-2448. A homology or identity, expressed as a percentage, of a homologous polypeptide according to the invention means in particular an identity, expressed as a percentage, of the amino acid residues based on the total length of one of the amino acid sequences described specifically herein.

The identity data, expressed as a percentage, may also be determined with the aid of BLAST alignments, algorithm blastp (protein-protein BLAST), or by applying the Clustal settings specified herein below.

If a protein glycosylation is possible, "functional equivalents" according to the invention comprise proteins of the abovementioned type in deglycosylated or glycosylated form, and modified forms which are available by altering the glycosylation pattern.

Homologs of the proteins or polypeptides according to the invention may be generated by mutagenesis, for example by point mutation, extension or truncation of the protein.

Homologs of the proteins according to the invention may be identified by screening combinatorial libraries of mutants such as, for example, truncated mutants. For example, a variegated library of protein variants can be generated by combinatorial mutagenesis at the nucleic acid level, such as, for example, by enzymatically ligating the mixture of synthetic oligonucleotides. A multiplicity of methods exist which can be used for generating libraries of potential homologs from a degenerate oligonucleotide sequence. The chemical synthesis of a degenerate gene sequence may be carried out in an automatic DNA synthesizer, and the synthetic gene can then be ligated into a suitable expression vector. The use of a degenerate set of genes makes it possible to provide, in a mixture, all those sequences which code for the desired set of potential protein sequences. Processes for synthesizing the degenerate oligonucleotides are known to the skilled worker (for example Narang, S. A. (1983) Tetrahedron 39:3; Itakura et al. (1984) Annu. Rev. Biochem. 53:323; Itakura et al., (1984) Science 198:1056; Ike et al. (1983) Nucleic Acids Res. 11:477).

A plurality of techniques for screening gene products of combinatorial libraries which have been generated by point mutations or truncation or for screening cDNA libraries for gene products with a selected property are known in the art. These techniques may be adapted to the rapid screening of the gene libraries which have been generated by combinatorial mutagenesis of homologs according to the invention. The most frequently used techniques for screening large gene libraries, as the basis for high-throughput analysis, comprise cloning the gene library into replicable expression vectors, transforming the suitable cells with the resulting vector library and expressing the combinatorial genes under conditions under which the detection of the desired activity facilitates the isolation of the vector which codes for the gene whose product has been detected. Recursive Ensemble Mutagenesis (REM), a technique which increases the frequency of functional mutants in the libraries, may be used in combination with the screening tests for identifying homologs (Arkin and Yourvan (1992) PNAS 89:7811-7815; Delgrave et al. (1993) Protein Engineering 6(3):327-331).

3. Nucleic Acids and Constructs 3.1 Nucleic Acids

Nucleic acids which code for the enzyme with cyclase activity as described above are also subject matter of the invention.

The present invention also relates to nucleic acids with a certain degree of identity to the specific sequences described herein.

"Identity" between two nucleic acids is understood as meaning the identity of the nucleotides over in each case the entire length of the nucleic acid, in particular the identity which is calculated by comparison with the aid of the Vector NTI Suite 7.1 Software from Informax (USA) using the Clustal method (Higgins D G, Sharp P M. Fast and sensitive multiple sequence alignments on a microcomputer. Comput Appl. Biosci. 1989 April; 5(2):151-1), setting the following parameters:

| Multiple alignment parameters: | |
| --- | --- |
| Gap opening penalty | 10 |
| Gap extension penalty | 10 |
| Gap separation penalty range | 8 |
| Gap separation penalty | off |
| % identity for alignment delay | 40 |
| Residue specific gaps | off |
| Hydrophilic residue gap | off |
| Transition weighting | 0 |
| Pairwise alignment parameter: | |
| FAST algorithm | on |
| K-tuple size | 1 |
| Gap penalty | 3 |
| Window size | 5 |
| Number of best diagonals | 5 |

Alternatively, the identity may also be determined according to the method of Chenna, Ramu, Sugawara, Hideaki, Koike, Tadashi, Lopez, Rodrigo, Gibson, Toby J, Higgins, Desmond G, Thompson, Julie D. Multiple sequence alignment with the Clustal series of programs. (2003) Nucleic Acids Res 31 (13):3497-500, according to the website: http://www.ebi.ac.uk/Tools/clustalw/index.html# and using the following parameters:

| DNA Gap Open Penalty | 15.0 |
| --- | --- |
| DNA Gap Extension Penalty | 6.66 |
| DNA Matrix | Identity |
| Protein Gap Open Penalty | 10.0 |
| Protein Gap Extension Penalty | 0.2 |
| Protein matrix | Gonnet |
| Protein/DNA ENDGAP | −1 |
| Protein/DNA GAPDIST | 4 |

All the nucleic acid sequences mentioned herein (single- and double-stranded DNA and RNA sequences, such as, for example, cDNA and mRNA) can be prepared in manner known per se by chemical synthesis from the nucleotide building blocks such as, for example, by fragment condensation of individual overlapping, complementary nucleic acid building blocks of the double helix. The chemical synthesis of oligonucleotides can be effected for example in a manner known per se by the phosphoamidite method (Voet, Voet, $2^{nd}$ ed., Wiley Press New York, pages 896-897). The adding-on of synthetic oligonucleotides and filling-in of gaps with the aid of the Klenow fragment of the DNA polymerase and ligation reactions as well as general cloning methods are described in Sambrook et al. (1989), Molecular Cloning: A laboratory manual, Cold Spring Harbor Laboratory Press.

Subject matter of the invention are also nucleic acid sequences (single- and double-stranded DNA and RNA sequences, such as, for example, cDNA and mRNA) which code for one of the above polypeptides and their functional equivalents, which are obtainable for example using artificial nucleotide analogs.

The invention relates both to isolated nucleic acid molecules, which code for polypeptides or proteins according to the invention or for biological active segments thereof, and nucleic acid fragments which can be used for example for use as hybridization probes or as primers for identifying or amplifying coding nucleic acids according to the invention.

The nucleic acid molecules according to the invention may additionally contain untranslated sequences at the 3'- and/or 5' end of the coding gene region.

The invention furthermore comprises the nucleic acid molecules which are complementary to the specifically described nucleotide sequences, or a segment thereof.

The nucleotide sequences according to the invention make it possible to generate probes and primers which may be used for identifying and/or cloning homologous sequences in other types of cells and organisms. Such probes or primers usually comprise a nucleotide sequence region which, under "stringent" conditions (see hereinbelow), hybridizes to at least approximately 12, preferably at least approximately 75, such as, for example, approximately 40, 50 or 75, contiguous nucleotides of a sense strand of a nucleic acid sequence according to the invention or of a corresponding antisense strand.

An "isolated" nucleic acid molecule is separated from the other nucleic acid molecules which are present in the natural source of the nucleic acid and may in addition be essentially free from other cellular material or culture media, if prepared by recombinant techniques, or free from chemical precursors or other chemicals if chemically synthesized.

A nucleic acid molecule according to the invention can be isolated by means of standard techniques of molecular biology and the sequence information provided according to the invention. For example, cDNA can be isolated from a suitable cDNA library by using one of the specifically disclosed complete sequences or a segment thereof as hybridization probe and standard hybridization techniques (as described, for example, in Sambrook, J., Fritsch, E. F. und Maniatis, T. Molecular Cloning: A Laboratory Manual. $2^{nd}$ ed., Cold Spring Harbor Laboratory, Cold Spring Harbor Laboratory Press, Cold Spring Harbor, N.Y., 1989). Moreover, a nucleic acid molecule comprising one of the disclosed sequences or a segment thereof can be isolated by polymerase chain reaction, with the oligonucleotide primers which have been generated on the basis of this sequence being used. The nucleic acid amplified thus can be cloned into a suitable vector and characterized by DNA sequence analysis. The oligonucleotides according to the invention can furthermore be prepared by standard synthesis methods, for example using an automatic DNA synthesizer.

Nucleic acid sequences according to the invention or derivatives thereof, homologs or parts of these sequences can be isolated from other bacteria for example using customary hybridization methods or the PCR technology, for example by genomic libraries or cDNA libraries. These DNA sequences hybridize under standard conditions to the sequences according to the invention.

"Hybridize" is understood as meaning the ability of a poly- or oligonucleotide to bind to an almost complementary sequence under standard conditions, while nonspecific binding between noncomplementary partners does not occur under these conditions. To this end, the sequences may be 90-100% complementary. The property of complementary sequences of being able to specifically bind to one another is exploited for example in the Northern or Southern blot technique or in primer binding in PCR or RT-PCR.

For the hydrization, short oligonucleotides of the conservative regions are advantageously used in. However, longer fragments of the nucleic acids according to the invention or the complete sequences may also be used for the hybridization. These standard conditions vary depending on the nucleic acid (oligonucleotide, longer fragment or complete sequence), or depending on which type of nucleic acid, DNA or RNA, is being used for the hybridization. Thus, for example, the melting temperatures for DNA:DNA hybrids are by approximately 10° C. lower than those of DNA:RNA-hybrids of the same length.

Depending on the nucleic acid, standard conditions are understood as meaning, for example, temperatures of between 42 and 58° C. in an aqueous buffer solution with a concentration of between 0.1 to 5×SSC (1×SSC=0.15 M NaCl, 15 mM sodium citrate, pH 7.2) or additionally in the presence of 50% formamide such as, for example, 42° C. in 5×SSC, 50% formamide. Advantageously, the hybridization conditions for DNA:DNA hybrids are 0.1×SSC and temperatures of between approximately 20° C. to 45° C., preferably between approximately 30° C. to 45° C. For DNA:RNA hybrids, the hybridization conditions are advantageously 0.1×SSC and temperatures of between approximately 30° C. to 55° C., preferably between approximately 45° C. to 55° C. These stated temperatures for the hybridization are examples of calculated melting point values for a nucleic acid with a length of approximately 100 nucleotides and a G+C content of 50% in the absence of formamide. The experimental conditions for the DNA hybridization are described in relevant textbooks of genetics, such as, for example, Sambrook et al., "Molecular Cloning", Cold Spring Harbor Laboratory, 1989, and can be calculated using formulae known by a person skilled in the art, for example as a function of the length of the nucleic acids, the type of the hybrids or the G+C content. Further information on hybridization can be obtained by a person skilled in the art from the following textbooks: Ausubel et al. (eds), 1985, Current Protocols in Molecular Biology, John Wiley & Sons, New York; Hames and Higgins (eds), 1985, Nucleic Acids Hybridization: A Practical Approach, IRL Press at Oxford University Press, Oxford; Brown (ed), 1991, Essential Molecular Biology: A Practical Approach, IRL Press at Oxford University Press, Oxford.

The "hybridization" may take place in particular under stringent conditions. Such hybridization conditions are described, for example, by Sambrook, J., Fritsch, E. F., Maniatis, T., in: Molecular Cloning (A Laboratory Manual), $2^{nd}$ ed., Cold Spring Harbor Laboratory Press, 1989, pages 9.31-9.57 or in Current Protocols in Molecular Biology, John Wiley & Sons, N.Y. (1989), 6.3.1-6.3.6.

"Stringent" hybridization conditions are taken to mean in particular: incubation at 42° C. overnight in a solution consisting of 50% formamide, 5×SSC (750 mM NaCl, 75 mM trisodium citrate), 50 mM sodium phosphate (pH 7.6), 5×Denhardt's solution, 10% dextran sulfate and 20 g/ml denatured, sheared salmon sperm DNA, followed by a step of washing the filters with 0.1×SSC at 65° C.

Subject matter of the invention are also derivatives of the specifically disclosed or derivable nucleic acid sequences.

Thus, for example, further cyclase-mutant-encoding nucleic acid sequences according to the invention may be derived for example from SEQ ID NO:1 or from the coding sequences to SEQ ID NO: 2 to 326, in particular SEQ ID NO: 2 to 6, by an F486 mutation or F486-analogous mutation and differ therefrom by addition, substitution, insertion or deletion of individual or several nucleotides, but continue to code for polypeptides with the desired property profile.

Also comprised in accordance with the invention are those nucleic acid sequences which comprise so-called silent mutations or which are modified in comparison with a specifically mentioned sequence in accordance with the codon usage of a specific source or host organism, as are naturally occurring variants such as, for example, splice variants or allelic variants, thereof.

Subject matter are likewise sequences obtainable by conservative nucleotide substitutions (i.e. the amino acid in question is replaced by an amino acid with the same charge, size, polarity and/or solubility).

Subject matter of the invention are also the molecules which are derived from the specifically disclosed nucleic acids by means of sequence polymorphisms. These genetic polymorphisms may exist between individuals within a population owing to natural variation. These natural variations usually bring about a variance of from 1 to 5% in the nucleotide sequence of a gene.

Derivatives of the cyclases-encoding nucleic acid sequences according to the invention derived from sequence SEQ ID NO: 1 or from one of the coding sequences to SEQ ID NO: 2 to 326, in particular SEQ ID NO: 2 to 6, are understood as meaning, for example, allelic variants which have at least 60% homology at the derived amino acid level, preferably at least 80% homology, especially preferably at least 90% homology over the entire sequence region (in respect of homology at the amino acid level, reference may be made to what has been said above in connection with the polypeptides). Advantageously, the homologies can be higher over part-regions of the sequences.

Furthermore, derivatives are understood as meaning homologs of the nucleic acid sequences according to the invention, for example fungal or bacterial homologs, truncated sequences, single-stranded DNA or RNA of the coding and noncoding DNA sequences.

Furthermore, derivatives are understood as meaning for example fusions with promoters. The promoters, which are arranged upstream of the specified nucleotide sequences, may have been changed by at least one nucleotide substitution, at least one insertion, inversion and/or deletion, without, however, adversely affecting the functionality/activity of the promoters. Moreover, the efficacy of the promoters may be enhanced by modifying their sequence, or the promoters may be exchanged fully for more effective promoters, also from organisms from different species.

3.2 Generation of Functional Mutants

Furthermore, a person skilled in the art is familiar with processes for generating functional mutants of enzymes according to the invention.

Depending on the technique used, a person skilled in the art can introduce entirely random or else more targeted mutations into genes or else noncoding nucleic acid sections (which are, for example, important for regulating expression) and subsequently construct the gene libraries. The methods of molecular biology which are required for this purpose are known to a person skilled in the art and described, for example, in Sambrook and Russell, Molecular Cloning. 3$^{rd}$ ed., Cold Spring Harbor Laboratory Press 2001.

Methods of modifying genes and thus of modifying the proteins encoded by them have long been known to a person skilled in the art, such as, for example,

- site-specific mutagenesis, where individual or multiple nucleotides of a gene are replaced in a targeted manner (Trower M K (Ed.) 1996; In vitro mutagenesis protocols. Humana Press, New Jersey),
- saturation mutagenesis, where a codon for any amino acid may be replaced or added at any gene locus (Kegler-Ebo D M, Docktor C M, DiMaio D (1994) Nucleic Acids Res 22:1593; Barettino D, Feigenbutz M, Valcfrel R, Stunnenberg H G (1994) Nucleic Acids Res 22:541; Barik S (1995) Mol. Biotechnol. 3:1),
- error-prone polymerase chain reaction (error-prone PCR), where nucleotide sequences are mutated by erroneously working DNA polymerases (Eckert K A, Kunkel T A (1990) Nucleic Acids Res. 18:3739);
- the SeSaM method (sequence saturation method), where preferential substitutions are prevented by the polymerase. Schenk et al., Biospektrum, vol. 3, 2006, 277-279
- the passaging of genes in mutator strains, in which, for example, an increased mutation rate of nucleotide sequences takes place on account of defective DNA repair mechanisms (Greener A, Callahan M, Jerpseth B (1996) An efficient random mutagenesis technique using an *E. coli* mutator strain. In: Trower M K (Ed.) In vitro mutagenesis protocols. Humana Press, New Jersey), or
- DNA shuffling, where a pool of closely related genes is formed and digested and the fragments are used as templates for a polymerase chain reaction, in which mosaic genes of full length are finally produced by repeated strand separation and reannealing (Stemmer W P C (1994) Nature 370:389; Stemmer W P C (1994) Proc. Natl. Acad. Sci. USA 91:10747).

Using "directed evolution" (described, inter alia, in Reetz M T and Jaeger K-E (1999), Topics Curr. Chem. 200:31; Zhao H, Moore J C, Volkov A A, Arnold F H (1999), Methods for optimizing industrial enzymes by directed evolution, In: Demain A L, Davies J E (Ed.) Manual of industrial microbiology and biotechnology. American Society for Microbiology), a person skilled in the art can also generate functional mutants in a selective manner and also on a large scale. Here, in a first step, gene libraries of the respective proteins are initially produced, it being possible to employ, for example, the methods indicated hereinabove. The gene libraries are expressed in a suitable manner, for example by bacteria or by phage display systems.

The relevant genes of host organisms that express functional mutants with properties which largely correspond to the desired properties may be subjected to a further round of mutation. The steps of mutation and selection or screening may be repeated iteratively until the functional mutants present possess the desired properties in an adequate measure. As a result of this iterative procedure, a limited number of mutations, such as, for example, 1, 2, 3, 4 or 5 mutations, may be performed stepwise, and assessed and selected for their effect on the respective enzyme property. Then, the selected mutant may be subjected to a further mutation step in the same manner. The number of individual mutants to be studied may be significantly decreased thereby.

The results according to the invention also provide important information with respect to structure and sequence of the respective enzymes, which are required for generating, in a targeted fashion, further enzymes with desired modified properties. In particular, it is possible to define so-called "hot spots", i.e. sequence segments which are potentially suitable for modifying an enzyme property via the introduction of targeted mutations.

Likewise, information is derivable in respect of amino acid sequence positions in whose surroundings mutations may be carried out which will presumably have little effect on the enzymatic activity and which may be referred to as potential "silent mutations".

3.3 Constructs

A subject matter of the invention are furthermore, in particular recombinant, expression constructs comprising, under the genetic control of regulatory nucleic acid sequences, a nucleic acid sequence which codes for a polypeptide according to the invention; and, in particular recombinant, vectors comprising at least one of these expression constructs.

According to the invention, an "expression unit" is understood as meaning a nucleic acid which has expression activity and which comprises a promoter as herein defined and which, after functional linkage to a nucleic acid to be expressed or to a gene, will regulate the expression, in other words the transcription and the translation, of this nucleic acid or this gene. This is why it is also referred to in this context as a "regulatory nucleic acid sequence". In addition to the promoter, further regulatory elements such as, for example, enhancers may be present.

According to the invention, an "expression cassette" or "expression construct" is understood as meaning an expression unit which is functionally linked to the nucleic acid to be expressed or the gene to be expressed. In contrast to an expression unit, an expression cassette, therefore, does not only comprise nucleic acid sequences which regulate transcription and translation, but also those nucleic acid sequences which are to be expressed as a protein as a result of transcription and translation.

Within the context of the invention, the terms "expression" or "overexpression" describe the production or increase of the intracellular activity of one or more enzymes in a microorganism which are encoded by the corresponding DNA. To this end, it is possible, for example, to introduce a gene into an organism, to replace an existing gene by a different gene, to increase the copy number of the gene(s), to use a strong promoter or to use a gene which codes for a corresponding enzyme with a high activity, and these measures can optionally be combined.

Preferably, such constructs according to the invention comprise a promoter 5'-upstream and a terminator sequence 3'-downstream of the respective coding sequence and, optionally, further customary regulatory elements, in each case operably linked to the coding sequence.

According to the invention, a "promoter", a "nucleic acid with promoter activity" or a "promoter sequence" is understood as meaning a nucleic acid which, in functional linkage with a nucleic acid to be transcribed, regulates the transcription of this nucleic acid.

In this context, a "functional" or "operable" linkage is understood as meaning, for example, the sequential arrangement of one of the nucleic acids with promoter activity and a nucleic acid sequence to be transcribed and optionally further regulatory elements such as, for example, nucleic acid sequences which ensure the transcription of nucleic acids and, for example, a terminator in such a way that each of the regulatory elements can fulfill its function upon transcription of the nucleic acid sequence. A direct linkage in the chemical sense is not necessarily required for this purpose. Genetic control sequences such as, for example, enhancer sequences can also exert their function on the target sequence from positions which are located at a greater distance, or indeed from other DNA molecules. Preferred arrangements are those in which the nucleic acid sequence to be transcribed is positioned behind (i.e. at the 3' end) of the promoter sequence so that the two sequences are covalently bonded to each other. In this context, the distance between the promoter sequence and the nucleic acid sequence to be expressed transgenically may be less than 200 base pairs or less than 100 base pairs or less than 50 base pairs.

In addition to promoters and terminator, the following may be mentioned as examples of other regulatory elements: targeting sequences, enhancers, polyadenylation signals, selectable markers, amplification signals, replication origins and the like. Suitable regulatory sequences are described, for example, in Goeddel, Gene Expression Technology: Methods in Enzymology 185, Academic Press, San Diego, Calif. (1990).

Nucleic acid constructs according to the invention comprise in particular a sequence coding for a cyclase, for example SEQ ID NO: 1, or coding for a cyclase as per SEQ ID NO. 2 to 326 or derivatives and homologs thereof, and the nucleic acid sequences which can be derived therefrom and which have been linked operatively or functionally with one or more regulatory signals, advantageously for controlling, for example increasing, gene expression.

In addition to these regulatory sequences, the natural regulation of these sequences may still be present before the actual structural genes and optionally may have been genetically modified so that the natural regulation has been switched off and expression of the genes has been enhanced. The nucleic acid construct may, however, also be of simpler construction, i.e. no additional regulatory signals have been inserted before the coding sequence and the natural promoter, with its regulation, has not been removed. Instead, the natural regulatory sequence is mutated such that regulation no longer takes place and the gene expression is increased.

A preferred nucleic acid construct advantageously also comprises one or more of the already mentioned "enhancer" sequences in functional linkage with the promoter, which sequences make possible an enhanced expression of the nucleic acid sequence. Additional advantageous sequences may also be inserted at the 3'-end of the DNA sequences, such as further regulatory elements or terminators. One or more copies of the nucleic acids according to the invention may be present in a construct. In the construct, other markers, such as genes which complement auxotrophisms or antibiotic resistances, may also optionally be present so as to select for the construct.

Examples of suitable regulatory sequences are present in promoters such as cos, tac, trp, tet, trp-tet, lpp, lac, lpp-lac, lacI$^q$, T7, T5, T3, gal, trc, ara, rhaP (rhaP$_{BAD}$)SP6, lambda-P$_R$ or in the lambda-P$_L$ promoter, and these are advantageously employed in Gram-negative bacteria. Further advantageous regulatory sequences are present for example in the Gram-positive promoters amy and SPO2, in the yeast or fungal promoters ADC1, MFalpha, AC, P-60, CYC1, GAPDH, TEF, rp28, ADH. Artificial promoters may also be used for regulation.

For expression in a host organism, the nucleic acid construct is inserted advantageously into a vector such as, for example, a plasmid or a phage, which makes possible optimal expression of the genes in the host. Vectors are also understood as meaning, in addition to plasmids and phages, all the other vectors which are known to the skilled worker, that is to say for example viruses such as SV40, CMV, baculovirus and adenovirus, transposons, IS elements, phasmids, cosmids and linear or circular DNA. These vectors are capable of being replicated autonomously in the host organism or else chromosomally. These vectors are a further development of the invention.

Suitable plasmids are, for example, in E. coli pLG338, pACYC184, pBR322, pUC18, pUC19, pKC30, pRep4, pHS1, pKK223-3, pDHE19.2, pHS2, pPLc236, pMBL24, pLG200, pUR290, pIN-III$^{113}$-B1, λgt11 or pBdCI, in Streptomyces pIJ101, pIJ364, pIJ702 or pIJ361, in Bacillus pUB110, pC194 or pBD214, in Corynebacterium pSA77 or pAJ667, in fungi pALS1, pIL2 or pBB116, in yeasts 2alphaM, pAG-1, YEp6, YEp13 or pEMBLYe23 or in plants pLGV23, pGHlac$^+$, pBIN19, pAK2004 or pDH51. The abovementioned plasmids are a small selection of the plasmids which are possible. Further plasmids are well known to the skilled worker and can be found for example in the book Cloning Vectors (Eds. Pouwels P. H. et al. Elsevier, Amsterdam-New York-Oxford, 1985, ISBN 0 444 904018).

In a further development of the vector, the vector which comprises the nucleic acid construct according to the invention or the nucleic acid according to the invention can advantageously also be introduced into the microorganisms in the form of a linear DNA and integrated into the host organism's genome via heterologous or homologous recombination. This linear DNA can consist of a linearized vector such as a plasmid or only of the nucleic acid construct or the nucleic acid according to the invention.

For optimal expression of heterologous genes in organisms, it is advantageous to modify the nucleic acid sequences to match the specific "codon usage" used in the organism. The "codon usage" can be determined readily by computer evaluations of other, known genes of the organism in question.

An expression cassette according to the invention is generated by fusing a suitable promoter to a suitable coding nucleotide sequence and a terminator or polyadenylation signal. Customary recombination and cloning techniques are used for this purpose, as are described, for example, in T. Maniatis, E. F. Fritsch and J. Sambrook, Molecular Cloning: A Laboratory Manual, Cold Spring Harbor Laboratory, Cold Spring Harbor, N.Y. (1989), and in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley Interscience (1987).

For expression in a suitable host organism, the recombinant nucleic acid construct or gene construct is advantageously inserted into a host-specific vector which makes possible optimal expression of the genes in the host. Vectors are well known to the skilled worker and can be found for example in "Cloning Vectors" (Pouwels P. H. et al., Ed., Elsevier, Amsterdam-New York-Oxford, 1985).

4. Microorganisms

Depending on the context, the term "microorganism" may refer to the wild-type microorganism or to a genetically modified, recombinant microorganism, or to both.

With the aid of the vectors according to the invention it is possible to generate recombinant microorganisms which are transformed for example with at least one vector according to the invention and which can be employed for the production of the polypeptides according to the invention. Advantageously, the above-described recombinant constructs according to the invention are introduced into a suitable host system and expressed therein. In this context, customary cloning and transfection methods which are known to the skilled worker, such as, for example, coprecipitation, protoplast fusion, electroporation, retroviral transfection and the like, are preferably used so as to allow expression of the abovementioned nucleic acids in the expression system in question. Suitable systems are described for example in Current Protocols in Molecular Biology, F. Ausubel et al., Ed., Wiley Interscience, New York 1997, or Sambrook et al. Molecular Cloning: A Laboratory Manual. $2^{nd}$ Ed., Cold Spring Harbor Laboratory, Cold Spring Harbor Laboratory Press, Cold Spring Harbor, N.Y., 1989.

Suitable recombinant host organisms for the nucleic acid according to the invention or the nucleic acid construct are, in principle, all prokaryotic or eukaryotic organisms. Microorganisms such as bacteria, fungi or yeasts are advantageously used as host organisms. Gram-positive or Gram-negative bacteria, preferably bacteria from the families Enterobacteriaceae, Pseudomonadaceae, Rhizobiaceae, Streptomycetaceae or Nocardiaceae, especially preferably bacteria from the genera *Escherichia, Pseudomonas, Streptomyces, Nocardia, Burkholderia, Salmonella, Agrobacterium, Clostridium* or *Rhodococcus*, are advantageously used. Very especially preferred is the genus and species *Escherichia coli*. Further advantageous bacteria can additionally be found in the group of the alpha-proteobacteria, beta-proteobacteria or gamma-proteobacteria.

In this context, the host organism(s) according to the invention contain(s) preferably at least one of the nucleic acid sequences, nucleic acid constructs or vectors which are described in the present invention and which code for an enzyme with phenylethanol dehydrogenase activity as defined hereinabove.

Depending on the host organism, the organisms used in the process according to the invention are grown or cultured in a manner with which the skilled worker is familiar. As a rule, microorganisms are grown in a liquid medium which comprises a carbon source, usually in the form of sugars, a nitrogen source, usually in the form of organic nitrogen sources such as yeast extract or salts such as ammonium sulfate, trace elements such as iron salts, manganese salts, magnesium salts and optionally vitamins, at temperatures of between 0° C. and 100° C., preferably between 10° C. to 60° C., while passing in oxygen gas. The pH of the liquid medium may be maintained at a fixed value, that is to say may be regulated during culturing, or not. Culturing may take place batchwise, semibatchwise or continuously. Nutrients may be provided at the beginning of the fermentation or fed in semicontinuously or continuously.

5. Recombinant Production of Enzymes According to the Invention

The invention furthermore relates to processes for the recombinant production of polypeptides according to the invention or functional biologically active fragments thereof, wherein a polypeptide-producing microorganism is cultured, the expression of the polypeptides is optionally induced, and the polypeptides are isolated from the culture. If desired, the polypeptides can also be produced on an industrial scale in this manner.

The microorganisms produced according to the invention may be cultured continuously or discontinuously by the batch method or the fed-batch method or the repeated fed-batch method. An overview of known cultivation methods can be found in the textbook by Chmiel (Bioprozeßtechnik 1. Einführung in die Bioverfahrenstechnik [Bioprocess technology 1. Introduction to bioprocess technology] (Gustav Fischer Verlag, Stuttgart, 1991)) or in the textbook by Storhas (Bioreaktoren und periphere Einrichtungen [Bioreactors and peripheral equipment] (Vieweg Verlag, Braunschweig/Wiesbaden, 1994)).

The culture medium to be used must suitably meet the requirements of the respective strains. Descriptions of culture media for various microorganisms are given in the manual "Manual of Methods for General Bacteriology" of the American Society for Bacteriology (Washington D.C., USA, 1981).

These media which can be used in accordance with the invention usually comprise one or more carbon sources, nitrogen sources, inorganic salts, vitamins and/or trace elements.

Preferred carbon sources are sugars, such as mono-, di- or polysaccharides. Very good carbon sources are, for example, glucose, fructose, mannose, galactose, ribose, sorbose, ribulose, lactose, maltose, sucrose, raffinose, starch or cellulose. Sugars can also be added to the media via complex compounds, such as molasses, or other by-products of sugar refining. It can also be advantageous to add mixtures of different carbon sources. Other possible carbon sources are oils and fats, for example soya oil, sunflower oil, peanut oil, and coconut fat, fatty acids such as, for example, palmitic acid, stearic acid or linoleic acid, alcohols, for example glycerol, methanol or ethanol, and organic acids, for example acetic acid or lactic acid.

Nitrogen sources are usually organic or inorganic nitrogen compounds or materials that comprise these compounds. Examples of nitrogen sources comprise ammonia gas or ammonium salts, such as ammonium sulfate, ammonium chloride, ammonium phosphate, ammonium carbonate or ammonium nitrate, nitrates, urea, amino acids or complex nitrogen sources, such as corn steep liquor, soya flour, soya protein, yeast extract, meat extract and others. The nitrogen sources may be used individually or as a mixture.

Inorganic salt compounds that can be present in the media comprise the chloride, phosphorus or sulfate salts of calcium, magnesium, sodium, cobalt, molybdenum, potassium, manganese, zinc, copper and iron.

Inorganic sulfur-comprising compounds, for example sulfates, sulfites, dithionites, tetrathionates, thiosulfates, sulfides as well as organic sulfur compounds, such as mercaptans and thiols, may be used as the sulfur source.

Phosphoric acid, potassium dihydrogen phosphate or dipotassium hydrogen phosphate or the corresponding sodium-comprising salts may be used as the phosphorus source.

Chelating agents may be added to the medium in order to keep the metal ions in solution. Especially suitable chelating agents comprise dihydroxyphenols, such as catechol or protocatechuate, or organic acids, such as citric acid.

The fermentation media used in accordance with the invention usually also comprise other growth factors such as vitamins or growth promoters, which include for example biotin, riboflavin, thiamine, folic acid, nicotinic acid, panthothenate and pyridoxine. Growth factors and salts often originate from the components of complex media, such as yeast extract, molasses, corn steep liquor and the like. Moreover, suitable precursors can be added to the culture medium. The exact composition of the compounds in the medium depends greatly on the respective experiment and is decided for each specific case individually. Information on media optimization can be found in the textbook "Applied Microbiol. Physiology, A Practical Approach" (Ed. P. M. Rhodes, P. F. Stanbury, IRL Press (1997), p. 53-73, ISBN 0 19 963577 3). Growth media can also be obtained from commercial suppliers, such as Standard 1 (Merck) or BHI (brain heart infusion, DIFCO) and the like.

All media components are sterilized, either by heat (20 min at 1.5 bar and 121° C.) or by filter sterilization. The components may be sterilized either together or separately if necessary. All media components may be present at the beginning of a culture or can be added either continuously or batchwise.

The culture temperature is normally between 15° C. and 45° C., preferably 25° C. to 40° C. and can be varied or kept constant during the experiment. The pH of the medium should be in the range of from 5 to 8.5, preferably around 7.0. The pH for growing can be controlled during growing by adding basic compounds such as sodium hydroxide, potassium hydroxide, ammonia or ammonia water, or acidic compounds such as phosphoric acid or sulfuric acid. Antifoams, for example fatty acid polyglycol esters, may be used for controlling foaming. To maintain the stability of plasmids, suitable selectively acting substances, such as, for example, antibiotics, may be added to the medium. To maintain aerobic conditions, oxygen or oxygen-comprising gas mixtures, such as, for example, ambient air, are passed into the culture. The temperature of the culture is normally in the range of from 20° C. to 45° C. The culture is continued until a maximum of the desired product has formed. This target is normally reached within 10 hours to 160 hours.

The fermentation liquor is subsequently processed further. Depending on the requirements, the biomass may be removed from the fermentation liquor completely or partially by separation techniques, for example centrifugation, filtration, decanting or a combination of these methods, or may be left in it completely.

If the polypeptides are not secreted into the culture medium, the cells can also be disrupted and the product can be obtained from the lysate by known protein isolation methods. The cells can optionally be disrupted with high-frequency ultrasound, high pressure, for example in a French press, by osmolysis, by the action of detergents; lytic enzymes or organic solvents, by means of homogenizers, or by a combination of several of the aforementioned methods.

The polypeptides may be purified by known chromatographic techniques, such as molecular sieve chromatography (gel filtration), such as Q-Sepharose chromatography, ion-exchange chromatography and hydrophobic chromatography, and with other usual techniques such as ultrafiltration, crystallization, salting out, dialysis and native gel electrophoresis. Suitable methods are described, for example, in Cooper, T. G., Biochemische Arbeitsmethoden [Biochemical methods], Verlag Walter de Gruyter, Berlin, N.Y., or in Scopes, R., Protein Purification, Springer Verlag, New York, Heidelberg, Berlin.

For isolating the recombinant protein, it may be advantageous to use vector systems or oligonucleotides which extend the cDNA by defined nucleotide sequences and therefore code for modified polypeptides or fusion proteins, which for example serve for easier purification. Suitable modifications of this type are, for example, so-called "tags", which function as anchors, for example the modification known as hexa-histidine anchor, or epitopes that can be recognized as antigens of antibodies (described, for example, in Harlow, E. and Lane, D., 1988, Antibodies: A Laboratory Manual. Cold Spring Harbor (N.Y.) Press). These anchors can serve for attaching the proteins to a solid carrier, for example a polymer matrix, which may, for example, be used as packing in a chromatography column, or may be used on a microtiter plate or on some other carrier.

At the same time, these anchors may also be used for recognition of the proteins. For recognition of the proteins, it is furthermore also possible to use usual markers, such as fluorescent dyes, enzyme markers, which form a detectable reaction product after reaction with a substrate, or radioactive markers, alone or in combination with the anchors for derivatization of the proteins.

To express mutants according to the invention, one may refer to the description of the expression of the wild-type enzyme EbN1 and the expression systems which are useful therefor, in WO2005/108590 and WO2006/094945, which are expressly referred to herewith.

6. Enzyme Immobilization

The enzymes used according to the invention can be used in free or immobilized form in the processes described herein. An immobilized enzyme is to be understood as an enzyme that is fixed to an inert carrier. Suitable carrier materials and the enzymes immobilized thereon are known from EP-A-1149849, EP-A-1069183 and DE-A 100193773 and from the references cited therein. In this respect, the disclosure of these documents is incorporated herein in its entirety by reference. The suitable carrier materials include, for example, clays, clay minerals such as kaolinite, diatomaceous earth, perlite, silica, aluminum oxide, sodium carbonate, calcium carbonate, cellulose powder, anion exchanger materials, synthetic polymers, such as polystyrene, acrylic resins, phenol/formaldehyde resins, polyurethanes and polyolefins, such as polyethylene and polypropylene. For making the supported enzymes, the carrier materials are usually employed in finely-divided, particulate form, with porous forms being preferred. The particle size of the carrier material is usually no more than 5 mm, in particular no more than 2 mm (particle-size distribution curve). Similarly, when using the dehydrogenase as a whole-cell catalyst, a free or immobilized form can be selected. Carrier materials are, for example, Ca alginate and carrageenan. Enzymes as well as cells may also be crosslinked directly with glutaraldehyde (cross-linking to CLEAs). Corresponding and other immobilization techniques are described, for example, in J. Lalonde and A. Margolin "Immobilization of Enzymes" in K. Drauz and H. Waldmann, Enzyme Catalysis in Organic Synthesis 2002, Vol. III, 991-1032, Wiley-VCH, Weinheim. Further information on biotransformations and bioreactors for carrying out processes according to the invention are also given, for example, in Rehm et al. (Ed.) Biotechnology, 2nd Edn., Vol. 3, Chapter 17, VCH, Weinheim.

7. Enzymatic Cyclization of Polyunsaturated Carboxylic Acids 7.1 General Aspects The cyclization process according to the invention is carried out in particular in the presence of an enzyme, where the enzyme is encoded by a nucleic acid sequence according to SEQ ID NO: 1 or a functional equivalent thereof, wherein the nucleic acid sequence is a constituent of a gene construct or vector. Such gene constructs or vectors are described in detail in international application PCT/EP2010/057696 on pages 16 to 20, which is expressly referred to here.

The host cell, which contains a gene construct or a vector, in which the nucleic acid sequence that codes for the enzyme with the desired activity is present is also called a transgenic organism. The generation of such transgenic organisms is known in principle and is discussed for example in international application PCT/EP2010/057696 on page 20, to which reference is expressly made here.

Cells from the group comprising bacteria, cyanobacteria, fungi and yeasts are preferably selected as transgenic organisms. The cell is preferably selected from fungi of the genus *Pichia* or bacteria of the genera *Escherichia, Corynebacterium, Ralstonia, Clostridium, Pseudomonas, Bacillus, Zymomonas, Rhodobacter, Streptomyces, Burkholderia, Lactobacillus* or *Lactococcus*. The cell is especially preferably selected from bacteria of the species *Escherichia coli, Pseudomonas putida, Burkholderia glumae, Streptomyces lividans, Streptomyces coelicolor* or *Zymomonas mobilis*.

Preference is given to a process according to the invention which is characterized in that the enzyme with the activity of a homofarnesylic acid cyclase is encoded by a gene which has been isolated from a microorganism, selected from among *Zymomonas mobilis, Methylococcus capsulatus, Rhodopseudomonas palustris, Bradyrhizobium japonicum, Frankia spec, Streptomyces coelicolor* and *Acetobacter pasteurianus*. Particular mention is given to the relevant genes from *Zymomonas mobilis, Streptomyces coelicolor, Bradyrhizobium japonicum* and *Acetobacter pasteurianus*.

Preference is furthermore given to a process according to the invention which is characterized in that the enzyme with the cyclase activity has been generated by a microorganism which overproduces the enzyme and which has been selected from the group of microorganisms consisting of the genera *Escherichia, Corynebacterium, Ralstonia, Clostridium, Pseudomonas, Bacillus, Zymomonas, Rhodobacter, Streptomyces, Burkholderia, Lactobacillus* and *Lactococcus*.

Specific mention is made of a process according to the invention which is characterized in that the enzyme with the cyclase activity has been produced by transgenic microorganisms of the species *Escherichia coli, Pseudomonas putida, Burkholderia glumae, Corynebacterium glutamicum, Saccharomyces cerevisiae, Pichia pastoris, Streptomyces lividans, Streptomyces coelicolor, Bacillus subtilis* or *Zymomonas mobilis*, which overproduce the enzyme with the cyclase activity.

Further embodiments for carrying out the biocatalytic cyclization process according to the invention.

The process according to the invention is characterized in that the enzyme is present in at least one of the following forms:
 a) free, optionally purified or partially purified polypeptide;
 b) immobilized polypeptide;
 c) polypeptide, isolated from cells, as per a) or b);
 d) intact cell, optionally quiescent or growing cells comprising at least one such polypeptide;
 e) lysate or homogenate of the cells as per d).

A further embodiment of the process according to the invention is characterized in that the cells are microorganisms, preferably transgenic microorganisms expressing at least one heterologous nucleic acid molecule encoding for a polypeptide with the cyclase activity.

A preferred embodiment of the process according to the invention comprises at least the following steps a), b) and d):
 a) to isolate or to recombinantly generate a microorganism producing an enzyme with cyclase activity from a natural source,
 b) to multiply this microorganism,
 c) optionally to isolate the enzyme with cyclase activity from the microorganism or to prepare a protein fraction comprising this enzyme, and
 d) to transfer the microorganism of step b) or the enzyme of step c) into a medium which comprises substrate, for example homofarnesylic acid of the general formula (Ia).

In the process according to the invention, a substrate is brought into contact and/or incubated with the enzyme having cyclase activity in a medium in such a way that the substrate, for example homofarnesylic acid is reacted in the presence of the enzyme to give sclareolide. The medium is preferably an aqueous reaction medium.

The pH of the aqueous reaction medium in which the process according to the invention is carried out by preference is advantageously maintained between pH 4 and 12, preferably between pH 4.5 and 9, especially preferably between pH 5 and 8.

The aqueous reaction media are preferably buffered solutions which, as a rule, have a pH of preferably from 5 to 8. A buffer which may be used can be a citrate, phosphate, TRIS (tris(hydroxymethyl)aminomethane) or MES buffer (2-(N-morpholino)ethanesulfonic acid). The reaction medium may additionally also comprise further additives such as, for example, detergents (for example taurodeoxycholate).

The substrate, for example homofarnesylic acid is preferably introduced into the enzymatic reaction at a concentration of 2-200 mM, especially preferably 5-25 mM, and can be resupplied continuously or batchwise.

As a rule, the enzymatic cyclization takes place at a reaction temperature below the deactivation temperature of the enzyme used and above $-10°$ C. Preferably, the process according to the invention is carried out at a temperature of between 0° C. and 95° C., especially preferably at a temperature of between 15° C. and 60° C., in particular between 20 and 40° C., for example at about 25 to 30° C.

Especially preferred is a process according to the invention in which the reaction of homofarnesylic acid to sclareolide is carried out at a temperature in the range of from 20 to 40° C. and/or a pH in the range of from 4 to 8.

Besides these one-phase aqueous systems, in another variant of the invention, two-phase systems are also used. Here, as well as an aqueous phase, organic non-water-miscible reaction media are used as the second phase. As a result, the reaction products accumulate in the organic phase. After the reaction, the product in the organic phase can readily be separated from the aqueous phase that comprises the biocatalyst.

Preferred is a process according to the invention characterized in that the conversion of homofarnesylic acid is carried out in one-phase aqueous systems or two-phase systems, or that the conversion of sparingly soluble homofarnesylic acid salts is carried out in two-phase aqueous/solid systems.

The reaction product can be extracted using organic solvents and optionally distilled for purification.

Examples of suitable organic solvents are aliphatic hydrocarbons, preferably having 5 to 8 carbon atoms, such as pentane, cyclopentane, hexane, cyclohexane, heptane, octane or cyclooctane, halogenated aliphatic hydrocarbons, preferably having one or two carbon atoms, such as dichloromethane, chloroform, carbon tetrachloride, dichloroethane or tetrachloroethane, aromatic hydrocarbons, such as benzene, toluene, the xylenes, chlorobenzene or dichlorobenzene, aliphatic acyclic and cyclic ethers or alcohols, preferably having 4 to 8 carbon atoms, such as ethanol, isopropanol, diethyl ether, methyl tert-butyl ether, ethyl tert-butyl ether, dipropyl ether, diisopropyl ether, dibutyl ether, tetrahydrofuran or esters such as ethyl acetate or n-butyl acetate or ketones such as methyl isobutyl ketone or dioxane, or mixtures of these. The abovementioned heptane, methyl tert-butyl ether, diisopropyl ether, tetrahydrofuran, ethyl acetate are especially preferably used.

The cyclases used in accordance with the invention can be used in the process according to the invention as free or immobilized enzyme, as already described above.

For the process according to the invention, it is possible to use quiescent or growing, free or immobilized cells which comprise nucleic acids, nucleic acid constructs or vectors which code for the cyclase. Disrupted cells, such as cell lysates or cell homogenates, may also be used. Disrupted cells are understood as meaning, for example, cells which have been permeabilized by a treatment for example with solvents, or cells that have been disrupted by enzymatic treatment, by mechanical treatment (for example French press or ultrasound) or by some other method. The crude extracts thus obtained are advantageously suitable for the process according to the invention. Purified or partially purified enzymes may also be used for the process.

If free organisms or enzymes are used for the process according to the invention, they are expediently separated prior to the extraction, for example by filtration or centrifugation.

The process according to the invention can be operated batchwise, semibatchwise or continuously.

7.2 Preferred Conversion of Homofarnesylic Acid into Sclareolide

In particular, the invention relates to a process for the preparation of sclareolide in which
  a) homofarnesylic acid is brought into contact and/or incubated with the homofarnesol ambroxan cyclase and
  b) sclareolide is isolated.

In one embodiment of the invention, homofarnesylic acid is brought into contact and/or incubated with the cyclase in a medium such that a conversion of homofarnesylic acid into sclareolide in the presence of cyclase takes place. Preferably, the medium is an aqueous reaction medium. The aqueous reaction media are preferably buffered solutions which, as a rule, have a pH of preferably from 5 to 8. A citrate, phosphate, TRIS (tris(hydroxymethyl)aminomethane), MES (2-(N-morpholino)ethanesulfonic acid) buffer may be used as the buffer. Furthermore, the reaction medium may additionally comprise other additions, such as, for example, detergents (for example taurodeoxycholate).

The substrate is preferably employed in the enzymatic conversion at a concentration of 5-100 mM, especially preferably of 15-25 mM, and may be supplied continuously or batchwise.

As a rule, the enzymatic cyclization is carried out at a reaction temperature below the deactivation temperature of the cyclase employed, and above −10° C. It is especially preferably in the range of from 0 to 100° C., in particular from 15 to 60° C. and specifically from 20 to 40° C., for example at approximately 30° C.

The reaction product sclareolide may be extracted with organic solvents, selected from the group of those mentioned hereinbelow, and, for purification, optionally be distilled.

Besides these one-phase aqueous systems, two-phase systems are also employed in a further variant of the invention. Here, ionic liquids are used as the second phase, but preferably organic reaction media which are immiscible with water are applied as the second phase. The reaction products thereby accumulate in the organic phase. After the reaction, ambroxan, present in the organic phase, can be separated readily from the aqueous phase, which contains the biocatalyst.

Nonaqueous reaction media are understood as meaning reaction media which comprise less than 1% by weight, preferably less than 0.5% by weight, of water, based on the total weight of the liquid reaction medium. The conversion can be carried out in particular in an organic solvent.

Examples of suitable organic solvents are aliphatic hydrocarbons, preferably having 5 to 8 carbon atoms, such as pentane, cyclopentane, hexane, cyclohexane, heptane, octane or cyclooctane, halogenated aliphatic hydrocarbons, preferably having one or two carbon atoms, such as dichloromethane, chloroform, carbon tetrachloride, dichloroethane or tetrachloroethane, aromatic hydrocarbons, such as benzene, toluene, the xylenes, chlorobenzene or dichlorobenzene, aliphatic acyclic and cyclic ethers or alcohols, preferably having 4 to 8 carbon atoms, such as ethanol, isopropanol, diethyl ether, methyl tert-butyl ether, ethyl tert-butyl ether, dipropyl ether, diisopropyl ether, dibutyl ether, tetrahydrofuran or esters such as ethyl acetate or n-butyl acetate or ketones such as methyl isobutyl ketone or dioxane, or mixtures of these. The abovementioned heptane, methyl tert-butyl ether, diisopropyl ether, tetrahydrofuran, ethyl acetate are especially preferably used.

The conversion of homofarnesylic acid to sclareolide may be performed not only in one-phase aqueous systems, but also in two-phase systems. In the case of two-phase systems, those mentioned hereinabove are employed. It is preferred to use the abovementioned organic solvents which are immiscible with water as the second phase. Thereby, the reaction products accumulate in the organic phase. After the reaction, ambroxan, which is in the inorganic phase, can be separated readily from the aqueous phase which comprises the biocatalyst.

A further subject matter of the present invention is a process for the biocatalytic preparation of sclareolide, characterized in that the enzyme is a polypeptide which is encoded by a nucleic acid molecule comprising at least one nucleic acid molecule selected from the group consisting of:
  a) nucleic acid molecule which codes for a polypeptide comprising the sequence shown in SEQ ID NO 2,
  b) nucleic acid molecule which comprises at least one polynucleotide of the sequence shown in SEQ ID NO 1;
  c) nucleic acid molecule which codes for a polypeptide whose sequence has an identity of at least 45% to the sequences SEQ ID NO 2;
  d) nucleic acid molecule according to (a) to (c) which codes for a functionally equivalent polypeptide or fragment of the sequence according to SEQ ID NO 2;
  e) nucleic acid molecule, coding for a functionally equivalent polypeptide with the activity of a homofarnesylic acid cyclase, which is obtained by amplifying a nucleic acid molecule from a cDNA library or from genomic DNA by means of the primers according to SEQ ID NO: No. 327 and 328, or the nucleic acid molecule, chemically synthesized by de-novo synthesis;
  f) nucleic acid molecule, coding for a functionally equivalent polypeptide with the activity of a homofarnesylic acid cyclase, which hybridizes under stringent conditions with a nucleic acid molecule according to (a) to (c);
  g) nucleic acid molecule, coding for a functionally equivalent polypeptide with the activity of a homofarnesylic acid cyclase, which can be isolated from a DNA library using a nucleic acid molecule according to (a) to (c) or their subfragments of at least 15 nt, preferably 20 nt, 30 nt, 50 nt, 100 nt, 200 nt or 500 nt, as a probe under stringent hybridization conditions; and
  h) nucleic acid molecule, coding for a functionally equivalent polypeptide with the activity of a homofarnesylic acid cyclase, wherein the sequence of the polypeptide has an identity of at least 30% to the sequences SEQ ID NO 2;

i) nucleic acid molecule, coding for a functionally equivalent polypeptide with the activity of a homofarnesylic acid cyclase, wherein the polypeptide is encoded by a nucleic acid molecule selected from the group of nucleic acids stated in a) to h)

j) nucleic acid molecule, coding for a functionally equivalent polypeptide with the activity of a homofarnesylic acid cyclase, wherein the polypeptide has an analogous or similar binding site as a polypeptide encoded by a nucleic acid molecule selected from the group of those described in a) to h).

For the purposes of the invention, an analogous or similar binding site is a conserved domain or motif of the amino acid sequence with a homology of 80%, especially preferably 85%, 86%, 87%, 88%, 89%, 90%, in particular 91%, 92%, 93%, 94%, 95%, 96%, 97%, 98% or 99% or 100%, which ensures the binding of the same substrate, in particular homofarnesylic acid.

Preferably, the nucleic acid molecule c) has an identity of at least 50%, 60%, 65%, 70%, 75%, 80%, especially preferably 85%, 86%, 87%, 88%, 89%, 90%, in particular 91%, 92%, 93%, 94%, 95%, 96%, 97%, 98% or 99%, to SEQ ID NO: 1.

Likewise, a functionally equivalent polypeptide has an identity of at least 50%, 60%, 65%, 70%, 75%, 80%, especially preferably 85%, 86%, 87%, 88%, 89%, 90%, in particular 91%, 92%, 93%, 94%, 95%, 96%, 97%, 98% or 99%, to SEQ ID NO: 2. Instead of the term "identity", the term "homologous" or "homology" may also be used synonymously.

The invention will now be described with reference to the following nonlimiting examples:

EXPERIMENTAL PART

Unless specific information has been given in the examples which follow, the general information hereinbelow applies.

A. General Information

All materials and microorganisms employed are commercially available products.

Unless otherwise specified, recombinant proteins are cloned and expressed by standard methods, such as, for example, as described by Sambrook, J., Fritsch, E. F. and Maniatis, T., Molecular cloning: A Laboratory Manual, 2$^{nd}$ Edition, Cold Spring Harbor Laboratory, Cold Spring Harbor Laboratory Press, Cold Spring Harbor, N.Y., 1989.

B. Examples

Example 1 Cloning of the Zm-SHC and Expression in *E. Coli*

The gene of the cyclase may be amplified from *Zymomonas mobilis* with the aid of the oligonucleotides Zm-SHC_fw and Zm-SHC_rev.

| Primer: | | |
|---|---|---|
| Primer No. | sequence (5'→3') | Position |
| Zm-SHC_fw | gcgctgtttcatatgggtattgaca (SEQ ID NO: 327) | N-term primer |
| Zm-SHC_rev | gcgcttaccctggatcctcgaaaat (SEQ ID NO: 328) | C-term primer |

In each case 100 ng of primers Zm-SHC_fw and Zm-SHC_rev were mixed in an equimolar ratio. The PCR with genomic DNA from *Z. mobilis* (ATCC31821) was carried out following the manufacturer's instructions using Pwo-polymerase (Roche Applied Science) and the following temperature gradient program: 95° C. for 3 min; 30 cycles at 95° C. for 30 sec., 50° C. for 30 sec and 72° C. for 3 min; 72° C. for 10 min.; 4° C. until used. The PCR product (~2.2 kb) was isolated by agaroso gel electrophoresis (1.2% electrophoresis gel, Invitrogen) and column chromatography (GFX Kit, Amersham Pharmacia) and subsequently sequenced (sequencing primer: Zm-SHC_fw and Zm-SHC_rev). The sequence obtained matches the published sequence.

The PCR product was digested with the restriction endonucleases NdeI and BamHI and ligated into suitably digested vector pDHE19.2 [9]. Sequencing the resulting plasmids gave the nucleic acid sequence shown in SEQ ID NO: 1. The corresponding amino acid sequence is shown in the following text/(SEQ ID NO:2):

```
Met Gly Ile Asp Arg Met Asn Ser Leu Ser Arg Leu Leu Met Lys Lys
 1               5                  10                  15

Ile Phe Gly Ala Glu Lys Thr Ser Tyr Lys Pro Ala Ser Asp Thr Ile
            20                  25                  30

Ile Gly Thr Asp Thr Leu Lys Arg Pro Asn Arg Arg Pro Glu Pro Thr
        35                  40                  45

Ala Lys Val Asp Lys Thr Ile Phe Lys Thr Met Gly Asn Ser Leu Asn
    50                  55                  60

Asn Thr Leu Val Ser Ala Cys Asp Trp Leu Ile Gly Gln Gln Lys Pro
65                  70                  75                  80

Asp Gly His Trp Val Gly Ala Val Glu Ser Asn Ala Ser Met Glu Ala
            85                  90                  95

Glu Trp Cys Leu Ala Leu Trp Phe Leu Gly Leu Glu Asp His Pro Leu
            100                 105                 110
```

```
Arg Pro Arg Leu Gly Asn Ala Leu Leu Glu Met Gln Arg Glu Asp Gly
        115                 120                 125

Ser Trp Gly Val Tyr Phe Ala Gly Asn Gly Asp Ile Asn Ala Thr
130                 135                 140

Val Glu Ala Tyr Ala Ala Leu Arg Ser Leu Gly Tyr Ser Ala Asp Asn
145                 150                 155                 160

Pro Val Leu Lys Lys Ala Ala Trp Ile Ala Glu Lys Gly Gly Leu
            165                 170                 175

Lys Asn Ile Arg Val Phe Thr Arg Tyr Trp Leu Ala Leu Ile Gly Glu
                180                 185                 190

Trp Pro Trp Glu Lys Thr Pro Asn Leu Pro Pro Glu Ile Ile Trp Phe
            195                 200                 205

Pro Asp Asn Phe Val Phe Ser Ile Tyr Asn Phe Ala Gln Trp Ala Arg
        210                 215                 220

Ala Thr Met Val Pro Ile Ala Ile Leu Ser Ala Arg Arg Pro Ser Arg
225                 230                 235                 240

Pro Leu Arg Pro Gln Asp Arg Leu Asp Glu Leu Phe Pro Glu Gly Arg
            245                 250                 255

Ala Arg Phe Asp Tyr Glu Leu Pro Lys Lys Glu Gly Ile Asp Leu Trp
                260                 265                 270

Sel Gln Phe Phe Arg Thr Thr Asp Arg Gly Leu His Trp Val Gln Ser
            275                 280                 285

Asn Leu Leu Lys Arg Asn Ser Leu Arg Glu Ala Ala Ile Arg His Val
        290                 295                 300

Leu Glu Trp Ile Ile Arg His Gln Asp Ala Asp Gly Gly Trp Gly Gly
305                 310                 315                 320

Ile Gln Pro Pro Trp Val Tyr Gly Leu Met Ala Leu His Gly Glu Gly
            325                 330                 335

Tyr Gln Leu Tyr His Pro Val Met Ala Lys Ala Leu Ser Ala Leu Asp
                340                 345                 350

Asp Pro Gly Trp Arg His Asp Arg Gly Glu Ser Ser Trp Ile Gln Ala
            355                 360                 365

Thr Asn Ser Pro Val Trp Asp Thr Met Leu Ala Leu Met Ala Leu Lys
        370                 375                 380

Asp Ala Lys Ala Glu Asp Arg Phe Thr Pro Glu Met Asp Lys Ala Ala
385                 390                 395                 400

Asp Trp Leu Leu Ala Arg Gln Val Lys Val Lys Gly Asp Trp Ser Ile
            405                 410                 415

Lys Leu Pro Asp Val Glu Pro Gly Gly Trp Ala Phe Glu Tyr Ala Asn
                420                 425                 430

Asp Arg Tyr Pro Asp Thr Asp Thr Ala Val Ala Leu Ile Ala Leu
            435                 440                 445

Ser Ser Tyr Arg Asp Lys Glu Glu Trp Gln Lys Lys Gly Val Glu Asp
        450                 455                 460

Ala Ile Thr Arg Gly Val Asn Trp Leu Ile Ala Met Gln Ser Glu Cys
465                 470                 475                 480

Gly Gly Trp Gly Ala Phe Asp Lys Asp Asn Asn Arg Ser Ile Leu Ser
            485                 490                 495

Lys Ile Pro Phe Cys Asp Phe Gly Glu Ser Ile Asp Pro Pro Ser Val
                500                 505                 510

Asp Val Thr Ala His Val Leu Glu Ala Phe Gly Thr Leu Gly Leu Ser
            515                 520                 525

Arg Asp Met Pro Val Ile Gln Lys Ala Ile Asp Tyr Val Arg Ser Glu
        530                 535                 540
```

```
Gln Glu Ala Glu Gly Ala Trp Phe Gly Arg Trp Gly Val Asn Tyr Ile
545                 550                 555                 560

Tyr Gly Thr Gly Ala Val Leu Pro Ala Leu Ala Ala Ile Gly Glu Asp
                565                 570                 575

Met Thr Gln Pro Tyr Ile Thr Lys Ala Cys Asp Trp Leu Val Ala His
            580                 585                 590

Gln Gln Glu Asp Gly Gly Trp Gly Glu Ser Cys Ser Ser Tyr Met Glu
            595                 600                 605

Ile Asp Ser Ile Gly Lys Gly Pro Thr Thr Pro Ser Gln Thr Ala Trp
            610                 615                 620

Ala Leu Met Gly Leu Ile Ala Ala Asn Arg Pro Glu Asp Tyr Glu Ala
625                 630                 635                 640

Ile Ala Lys Gly Cys His Tyr Leu Ile Asp Arg Gln Glu Gln Asp Gly
                645                 650                 655

Ser Trp Lys Glu Glu Glu Phe Thr Gly Thr Gly Phe Pro Gly Tyr Gly
            660                 665                 670

Val Gly Gln Thr Ile Lys Leu Asp Asp Pro Ala Leu Ser Lys Arg Leu
            675                 680                 685

Leu Gln Gly Ala Glu Leu Ser Arg Ala Phe Met Leu Arg Tyr Asp Phe
        690                 695                 700

Tyr Arg Gln Phe Phe Pro Ile Met Ala Leu Ser Arg Ala Glu Arg Leu
705                 710                 715                 720

Ile Asp Leu Asn Asn
                725
```

The plasmid pDHE-Zm-SHC-1 was transformed into the strain *E. coli* TG10 pAgro4 pHSG575 [Takeshita et al., *Gene* 1987, 61:63-74; Tomoyasu et al., *Mol Microbiol* 2001, 40:397-413]. The recombinant *E. coli* were named *E. coli* LU15568.

Example 2: Provision of Recombinant Homofarnesol Cyclase from *Z. Mobilis*

Inoculated from a suitable 2 ml preculture, *E. coli* LU15568 was grown for 16 h at 37° C. in 20 ml LB-Amp/Spec/Cm (100 µg/l ampicillin; 100 µg/l spectinomycin; 20 µg/l chloramphenicol), 0.1 mM IPTG, 0.5 g/l rhamnose in 100 ml Erlenmeyer flasks (with baffles), centrifuged at 5000*g/10 min and stored at 4° C. Protein extract was prepared by suspending the cell pellet in 15 ml disruption buffer (0.2 M Tris/HCl, 0.5 M EDTA, pH 8.0), 375 U benzonase (for example Novagen, 25 U/µL), 40 µL PMSF (100 mM, dissolved in i-PropOH), 0.8 g sucrose and approx. 0.5 mg of lysozyme. The reaction mixture was mixed and incubated on ice for 30 min. Thereafter, the mixture was frozen at −20° C.

After the reaction mixture had defrosted, it was made up to approx. 40 ml with distilled water and again incubated on ice for 30 min.

Thereafter, the cells were disrupted 3 times for 3 min using ultrasound (HTU-Soni 130, by G. Heinemann, Schwäbisch-Hall, amplitude 80%, 15" pulse/15" pause). After the disruption, the cell debris was removed by centrifugation for 60 min at 4° C. and 26 900*g. The supernatant was discarded and the pellet was resuspended in 100 ml solubilization buffer (50 mM Tris/HCl, 10 mM MgCl2× 6H2O, 1% Triton X-100, pH 8.0) and comminuted in a Potter for approx. 5 min. Thereafter, the suspension was maintained on ice for 30 min.

The homogenized extract was recentrifuged for 1 h at 4° C. and 26 900*g, and the pellet was discarded. The extract was employed for the enzyme assays and may be stowed over several weeks at −20° C. without suffering activity losses. The protein content was in the range of 1 mg/ml.

Example 3: Activity Determination of the Recombinant Cyclase from *E. Coli* LU15568

Figure 1B:
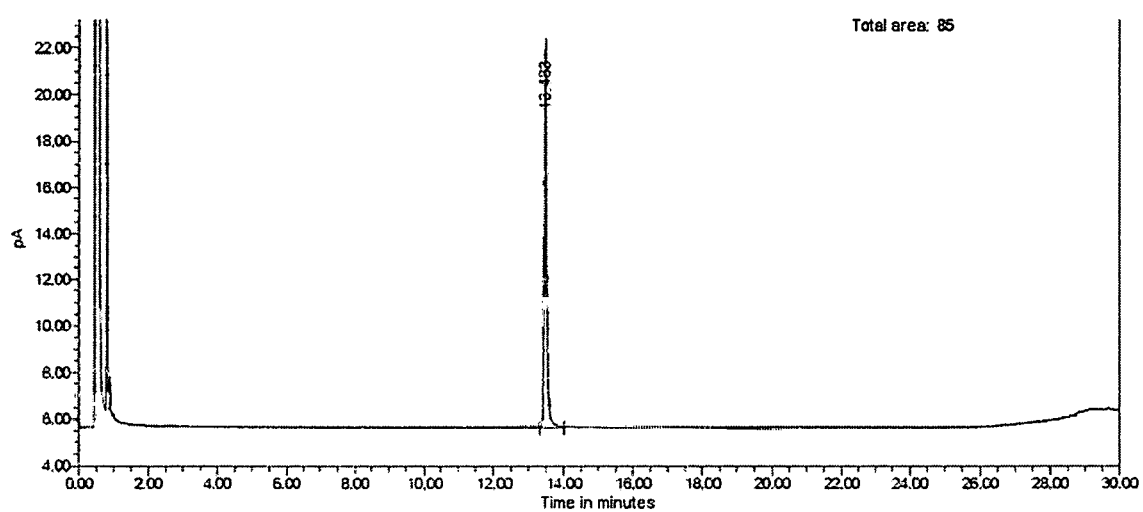

Homofarnesylic acid (1b, (3E,7E)-4,8,12-trimethyltrideca-3,7,11-trienoic acid)) was incubated with the protein preparation described in example 2. Specifically, 0.0412 g of homofarnesylic acid were weighed (20 mM in the reaction mixture; purity 85.1% composed of Z,Z 0.44%, E,Z 10.13%, E,E 74.93%), 2.913 ml of water; 0.350 ml of sodium citrate buffer (1M sodium citrate pH 5.4), 0.560 ml MgCl$_2$ (0.5M solution) were pipetted in, and the mixture was warmed for 30 min at 37° C., with stirring. The reaction started with the addition of *E. coli* LU15568 homogenate (protein content 35 mg/ml), warmed to 37° C. The reaction mixture was stirred on a magnetic stirrer in an oil bath for 24 h at pH 5.0 at 37° C. at maximum stirring speed. The pH was adjusted during the reaction using 0.5M HCl. After incubation for 24 hours, 0.500 ml from the reaction mixture were extracted by vortexing for 30 seconds with 1000 ml of n-heptane/n-propanol 3:2. The organic supernatant after the phase separation was employed in the GC analysis (cf. FIG. 1).

Using the analyses described hereinbelow in greater detail, a conversion rate of 74.5% in total of 82.7% from the E,E isomer was determined.

The conversion of homofarnesylic acid (1b) into sclareolide (3) can be determined with the following GC system:
Column: 10 m Optima 1
Temperature profile:
 0 min: 100° C.
 5° C./min to 200° C.
 After 5 min: 30° C./min to 320° C.
 thereafter constant
 Duration of the method: 30 min
Injector temperature: 280° C.

Retention times (RT):
 Homofarnesylic acid: peak 1 at 11.7 min, peak 2 at 12.1 min;
 Sclareolide: approx. 13.5 min A calibration series, with the aid of which the concentration of unknown samples was determined, is established using authentic material (Sigma, catalog No.: 358002).

Reference is made expressly to the disclosure of the publications cited herein.

---

Sequences:

SEQ ID NO: 1-26 Nucleic acid/amino acid sequences of various SHC genes

SEQ ID NO: 327-328 PCR primer

What follows now is a list of SHC enzyme sequences which are particularly useful in accordance with the invention:
Enzyme sequences >seq_ID 4
MNMASRFSLKKILRSGSDTQGTNVNTLIQSGTSDIVRQKPAPQEPADLSALKAMGNSLTHTLSS
ACEWLMKQQKPDGHWVGSVGSNASMEAEWCLALWFLGLEDHPLRPRLGKALLEMQRPDGS
WGTYYGAGSGDINATVESYAALRSLGYAEDDPAVSKAAAWIISKGGLKNVRVFTRYWLALIGE
WPWEKTPNLPPEIIWFPDNFVFSIYNFAQWARATMMPLAILSARRPSRPLRPQDRLDALFPGG
RANFDYELPTKEGRDVIADFFRLADKGLHWLQSSFLKRAPSREAAIKYVLEWIIWHQDADGGW
GGIQPPWVYGLMALHGEGYQFHHPVMAKALDALNDPGWRHDKGDASWIQATNSPVWDTML
SLMALHDANAEERFTPEMDKALDWLLSRQVRVKGDWSVKLPNTEPGGWAFEYANDRYPDTD
DTAVALIAIASCRNRPEWQAKGVEEAIGRGVRWLVAMQSSCGGWGAFDKDNNKSILAKIPFCD
FGEALDPPSVDVTAHVLEAFGLLGLPRDLPCIQRGLAYIRKEQDPTGPWFGRWGVNYLYGTGA
VLPALAALGEDMTQPYISKACDWLINCQQENGGWGESCASYMEVSSIGHGATTPSQTAWALM
GLIAANRPQDYEAIAKGCRYLIDLQEEDGSWNEEEFTGTGFPGYGVGQTIKLDDPAISKRLMQG
AELSRAFMLRYDLYRQLFPIIALSRASRLIKLGN >seq_ID 2
MGIDRMNSLSRLLMKKIFGAEKTSYKPASDTIIGTDTLKRPNRRPEPTAKVDKTIFKTMGNSLNN
TLVSACDWLIGQQKPDGHWVGAVESNASMEAEWCLALWFLGLEDHPLRPRLGNALLEMQRE
DGSWGVYFGAGNGDINATVEAYAALRSLGYSADNPVLKKAAAWIAEKGGLKNIRVFTRYWLALI
GEWPWEKTPNLPPEIIWFPDNFVFSIYNFAQWARATMVPIAILSARRPSRPLRPQDRLDELFPE
GRARFDYELPKKEGIDLWSQFFRTTDRGLHWVQSNLLKRNSLREAAIRHVLEWIIRHQDADGG
WGGIQPPWVYGLMALHGEGYQLYHPVMAKALSALDDPGWRHDRGESSWIQATNSPVWDTM
LALMALKDAKAEDRFTPEMDKAADWLLARQVKVKGDWSIKLPDVEPGGWAFEYANDRYPDTD
DTAVALIALSSYRDKEEWQKKGVEDAITRGVNWLIAMQSECGGWGAFDKDNNRSILSKIPFCD
FGESIDPPSVDVTAHVLEAFGTLGLSRDMPVIQKAIDYVRSEQEAEGAWFGRWGVNYIYGTGA
VLPALAAIGEDMTQPYITKACDWLVAHQQEDGGWGESCSSYMEIDSIGKGPTTPSQTAWALM
GLIAANRPEDYEAIAKGCHYLIDRQEQDGSWKEEEFTGTGFPGYGVGQTIKLDDPALSKRLLQG
AELSRAFMLRYDFYRQFFPIMALSRAERLIDLNN >seq_ID 5
MTVTSSASARATRDPGNYQTALQSTVRAAADWLIANQKPDGHWVGRAESNACMEAQWCLAL
WFMGLEDHPLRKRLGQSLLDSQRPDGAWQVYFGAPNGDINATVEAYAALRSLGFRDDEPAVR
RAREWIEAKGGLRNIRVFTRYWLALIGEWPWEKTPNIPPEVIWFPLWFPFSIYNFAQWARATLM
PIAVLSARRPSRPLPPENRLDALFPHGRKAFDYELPVKAGAGGWDRFFRGADKVLHKLQNLGN
RLNLGLFRPAATSRVLEWMIRHQDFDGAWGGIQPPWIYGLMALYAEGYPLNHPVLAKGLDALN
DPGWRVDVGDATYIQATNSPVWDTILTLLAFDDAGVLGDYPEAVDKAVDWVLQRQVRVPGDW
SMKLPHVKPGGWAFEYANNYYPDTDDTAVALIALAPLRHDPKWKAKGIDEAIQLGVDWLIGMQ
SQGGGWGAFDKDNNQKILTKIPFCDYGEALDPPSVDVTAHIIEAFGKLGISRNHPSMVQALDYI
RREQEPSGPWFGRWGVNYVYGTGAVLPALAAIGEDMTQPYIGRACDWLVAHQQADGGWGE
SCASYMDVSAVGRGTTTASQTAWALMALLAANRPQDKDAIERGCMWLVERQSAGTWDEPEF
TGTGFPGYGVGQTIKLNDPALSQRLMQGPELSRAFMLRYGMYRHYFPLMALGRALRPQSHS >seq_ID 6
MTVSTSSAFHHSSLSDDVEPIIQKATRALLEKQHQDGHWVFELEADATIPAEYILLKHYLGEPED
LEIEAKIGRYLRRIQGEHGGWSLFYGGDLDLSATVKAYFALKMIGDSPDAPHMLRARNEILARG
GAMRANVFTRIQLALFGAMSWEHVPQMPVELMLMPEWFPVHINKMAYWARTVLVPLLVLQAL
KPVARNRRGILVDELFVPDVLPTLQESGDPIWRRFFSALDKVLHKVEPYWPKNMRAKAIHSCV
HFVTERLNGEDGLGAIYPAIANSVMMYDALGYPENHPERAIARRAVEKLMVLDGTEDQGDKEV
YCQPCLSPIWDTALVAHAMLEVGGDFAFKSAISALSWLKPQQILDVKGDWAWRRPDLRPGGW
AFQYRNDYYPDVDDTAVVTMAMDRAAKLSDLHDDFEESKARAMEWTIGMQSDNGGWGAFDA
NNSYTYLNNIPPADHGALLDPPTVDVSARCVSMMAQAGISITDPKMKAAVDYLLKEQEEDGSW
FGRWGVNYIYGTWSALCALNVAALPHDHLAIQKAVAWLKNIQNEDGGWGENCDSYALDYSGY
EPMDSTASQTAWALLGLMAVGEANSEAVTKGINWLAQNQDEEGLWKEDYYSGGGFPRVFYL
RYHGYSKYFPLWALARYRNLKKANQPIVHYGM

SEQUENCE LISTING (328 sequences)

SEQ ID NO: 1 - DNA, 2178 bp, Zymomonas mobilis
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 2 - protein, 725 aa, Zymomonas mobilis
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 3 - protein, 680 aa, Streptomyces coelicolor
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 4 - protein, 720 aa, Acetobacter pasteurianus
MNMASRFSLKKILRSGSDTQGTNVNTLIQSGTSDIVRQKPAPQEPADLSALKAMGNSLTHTLSSACEWLMKQQKPDGHWVGSVGSNASMEAEWCLALWFLGLEDHPLRPRLGKALLEMQRPDGSWGTYYGAGSGDINATVESYAALRSLGYAEDDPAVSKAAAWIISKGGLKNVRVFTRYWLALIGEWPWEKTPNLPPEIIWFPDNFVFSIYNFAQWARATMMPLAILSARRPSRPLRPQDRLDALFPGGRANFDYELPTKEGRDVIADFFRLADKGLHWLQSSFLKRAPSREAAIKYVLEWIIWHQDADGGWGGIQPPWVYGLMALHGEGYQFHHPVMAKALDALNDPGWRHDKGDASWIQATNSPVWDTMLSLMALHDANAEERFTPEMDKALDWLLSRQVRVKGDWSVKLPNTEPGGWAFEYANDRYPDTDDTAVALIAIASCRNRPEWQAKGVEEAIGRGVRWLVAMQSSCGGWGAFDKDNNKSILAKIPFCDFGEALDPPSVDVTAHVLEAFGLLGLPRDLPCIQRGLAYIRKEQDPTGPWFGRWGVNYLYGTGAVLPALAALGEDMTQPYISKACDWLINCQQENGGWGESCASYMEVSSIGHGATTPSQTAWALMGLIAANRPQDYEAIAKGCRYLIDLQEEDGSWNEEEFTGTGFPGYGVGQTIKLDDPAISKRLMQGAELSRAFMLRYDLYRQLFPIIALSRASRLIKLGN

SEQ ID NO: 5 - protein, 684 aa, Bradyrhizobium sp.
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 6 - protein, 658 aa, Zymomonas mobilis
MTVSTSSAFHHSSLSDDVEPIIQKATRALLEKQHQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAIQKAVAWLKNIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 7 - protein, 648 aa, Acidithiobacillus caldus
MNPVVHNLTRPHRSAEPRPSALQRSIAAAQAALLQHQAADGHWCFEFEADCTIPAEYILMMHYMDERDAALEAKMAAYLRRKQENHGGWSLYHGGHFDMSASVKAYFALKLAGDDPEAAHMRRARSAILAHGGAERANVFTRITLALFGQVPWRAVPFIPVEILLFPRWFPMHIYKVASWSRTVMVPLFILCSLKPQAKNPLGVHIRELFTRPPEDIDDYFAHALQGWVSRIFLWFDRLGRALESWIPQALRRRAIARAEAWFIERLNGEDGLNGIFPAMVNAHEALALLGYAAEHPYRQQTRAALTKLVVERAGEAYCQPCVSPVWDTCLALHALLEADGDVSEAARRSMQWLLDRQITDAPGDWRERRPHLAGGGWAFQYANPYYPDLDDTAAVAWALARARRPEDRPAVERAANWLAGMQSRNGGFGAYDVDNTYYYLNEIPFADHKALLDPPTADVSGRVLAFLAILDREQDAPVRARLIQYLLREQEPSGAWFGRWGTNYIYGTWSVLMGMAELRDPGAEVRDAMARAAHWLRSVQQDDGGWGESNDSYADPGLAGLGQESTAAQTAWACLALMAAGDSDSESLRRGIQWLQRHQEQPGDWQDPYFNAPGFPRVFYLTYHGYKIYFPLWALARYRNITERHCA

SEQ ID NO: 8 - protein, 643 aa, Acidithiobacillus ferrooxidans
MNRMLQPLHSGAGIFRSSLDRVIAQARQALGGRQAEDGHWCFEFEADCTIPAEYILMQHYMDERDEALEARIAVYLRGKQADHGGWPLYYGGHFDLSASVKVYYALKLAGDDPELPHMRRAREAILAHGGAERSNVFTRITLALFAQVPWRAVPFIPVEIMLLPRWFPFHIYKVASWSRTVMVPLFILCSLKARAKNPLQVHIRELFRRPPDQITDYFSHARRGIVAYIFLSLDRFWRLMEGWIPHGIRRRALKKAEAWFTARINGEDGLNGIFPAMVNAHEALELLGYPPDHDYRRQTGAALRKLVVERANDAYCQPCVSPVWDTCLALHALLEEDGEVSPAVQNGIRWLKNRQIGAEPGDWRESRPHLAGGGWAFQYANPYYPDLDDTAAVGWALARAGRAEDRDSIEKAANWLAGMQSRNGGFGAYDVDNTHYYLNEIPFADHKALLDPPTADVTGRVVAFLAHLARPRDRDVLRRAVAYLLREQESSGAWFGRWGTNYIYGTWSVLMALAELNDPSLKPTMERAAYWLRAVQQGDGGWGESNDSYSDPGLAGMGQTSTAAQTAWACLGLMAAGDRDSVALHRGIAWLQAHQEGDGCWQAPFFNAPGFPKVFYLIYHGYAFYFPLWALARYRNLGCMAHE

SEQ ID NO: 9 - protein, 679 aa, Acidobacterium capsulatum
MSVSERAQPGGNPIPGSTSQSAVKFGRIDAALEDVKRAIAGAKDRVFAQQSKDGWWCGELEADSMLEADYIFAHTLLGTGDAGKMKRALTEMLRYQNEDGSWSIYPGGPGNISLTVKCYFSAKLMGMTADNPILVKAREWILAHGGVVECNTFTKIYLCFLGQYEYDAVPAIPPEIVLFPNWFYFNIYEISSWSRAILVPLSIAYAKKPFKKIPPEQGIDELFVGGREKANLHLRWDSKNLLSWRNFFLALDRVTHWFERVHIRPLRSIALKKAEKWMLARFEMSDGLGAIYPAMLNAIIALRCLGYSLDDPQVLRAMDEFEKLGIDEPEGTAEYAEPTFRMQPCVSPVWDTAQAVFALGEAGVPRNDPRMQKAADWLLSKEVRHKGDWAMKVRNAQPGGWYFEFNNEFYPDVDDSAQVLLALNKVDNPRERYQYDVCQRAIDWIFAMQCRNGGWASFDKDNTKMIFQYVPFADHNAMLDPPTVDITGRILEMLATYGYTRKDRRVEKAIKFIYDEQEPDGSWFGRWGVNYLYGTFLVLRGLEAIGVWNHEPQIQQAAEWIRSVQNADGGWGETCGSYDDPNTRGVGPSTPSQTAWAILGLLSAGDDRSDSVAKGIKWLLAHQKPDGGWDESTGSGSKHQALYTGTGFPRVFYLAYHQYRDYFPLLALTNYEKAMERGE

SEQ ID NO: 10 - protein, 633 aa, Acidothermus cellulolyticus
MTQASVREDAKAALDRAVDYLLSLQDEKGFWKGELETNVTIEAEDLLLREFLGIRTPDITAETARWIRAKQRSDGTWATFYDGPPDLSTSVEAYVALKLAGDDPAAPHMEKAAAYIRGAGGVERTRVFTRLWLALFGLWPWDDLPTLPPEMIFLPSWFPLNIYDWGCWARQTVVPLTIVSALRPVRPIPLSIDEIRTGAPPPPRDPAWTIRGFFQRLDDLLRGYRRVADHGPARLFRRLAMRRAAEWIIARQEADGSWGGIQPPWVYSLIALHLLGYPLDHPVLRRGLDGLNGFTIREETADGAVRRLEACQSPVWDTALAVTALRDAGLPADHPRVQAAARWLVGEEVRVAGDWAVRRPGLPPGGWAFEFANDNYPDTDDTAEVVLALRRVRLEDADQQALEAAVRRATTWVIGMQSTDGGWGAFDADNTRELVLRLPFCDFGAVIDPPSADVTAHIVEMLAALGMRDHPATVAGVRWLLAHQEPDGSWFGRWGANHIYGTGAVVPALIAAGVSPDTPPIRRAIRWLEEHQNPDGGWGEDLRSYTDPALWVGRGVSTASQTAWALLALLAAGEEASPAVDRGVRWLVTTQQPDGGWDEPHYTGTGFPGDFYINYHLYRLVFPISALGRYVNR

SEQ ID NO: 11 - protein, 695 aa, Adiantum capillus-veneris
MLPYNQDHHFGKVAENATMPPTLDEAIERSQDFLLSLQYPEGYWWAELEANVTLTAQTIMLYKILGIDHKYPIHKMKTYILRTQRAHGGWEIFYGDGGCLSTTIGAYMALRILGVPKTDPVLQKALKLIHSKGGVTKSRMFTKICLALLGCYDWKGIPSLPPWLVLLPSWFPFSLYDTASWVRGCVVPLTIIFDKKPVYKLNPLLCLDELYSEGKGKARVHLSFIPGDWTSNFFVGLDHVFKYMENLGVVPFRQWGIKEAERWTLERHEDSGDFHGIYPPMFYSIVSYSLLGYEITDPVVHRALESMRGFTVEREDECVVQSCISPMWDTAFVIRSLAESGLQPDHPALQKAGEWLLQKQATQHGNWFYKKRTGRAGGWAFQFFNRWYPDVDDSAAVSMALNAIKLQDDDVKKGAIKRCAEWISVMQCKDGGWAAYDCDNDREWLNCTPFGDLKAMIDPNTVDVTARVLEMVGRVKEAGDASAILPPRAIARGLAYLRREQETEGCWYGRWGVNYIYGTSGALMALALVAPSTHKEEIERGARWLVEVQNKRGTKGANGYSHTNGAREGGVAMNGNCKNMGAPEDGGWGETCFSYNDITLKGRNEVSTVSQTAWALQGLLAAGDALGKYEVESIEHGVQYLLSTQRKDGSWCEKHFTGGGFPRFFYIRYHLYAGHFPLSALARYRDRVRAGKMAK

SEQ ID NO: 12 - protein, 740 aa, Ajellomyces capsulatus
MMYNNQWYFNQFNDIFCFPEQQKEYFPPTGTNISLNLKKRPDRQLLAHGASDLNGPFHLSQHNAFSAMLLAEVQKVLRLAVGHSLDLQRTDGAWCGEVHSNATFTAQYVFLQQQLGLPLDPTEIEGLSRWLFSQQNEDGSWGLGPGLGGDVSTTTETYLALKILGVSPEDPRMAAARSSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFNSPLRNLSRRKIINWILDHQEQSGEWAGYWPPQHNNIWALSLEGYSLDHPVLRRGIAAVKSFVLHDVTGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDGPLESRLRASSQLAIAYLLGCQENNGSWWGRWGVNYLYGTSNVLCGLAYYYDRSGLSKGDGKSNSHIVSAVDRASEWLKARQHSNGGWGEGPESYDSAQLAGCGQPTASQSAWVTMALLNYLSPTDEVIQRGISYLVRSQVKYGDESRATWPLERYTATGFPGHLYMEYDYYRHYFPIMALGRYVNKLSESHKLL

SEQ ID NO: 13 - protein, 648 aa, Ajellomyces capsulatus
MAQMASSLGSPRLLLRMGREAAQQQHLASGTEVQKALRLAVGHSLDLQRTDGAWCGEVHSNATFTAQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGFRFLGQYFNSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRQCFGMMMAGRHGYSLDCQLETRLRASSQLAIAYLLGCQENNGSWWGRWGVNYLYGTSNVLCGLAYYYDRSSLSKGDGKSNSNIVSAVDRASEWLKARQHSNGGWGEGLESYDNAQLAGCGQPTASQSAWVTMALLNYLSPTDEVIQRGVSYLVRNQVKYGDESRATWPLERYTATGFPGHLYMEYDYYRHYFPIMALGRYVNKLSGSHKLL

SEQ ID NO: 14 - protein, 673 aa, Ajellomyces capsulatus
MLLAEVQKALRLAVGHSLDLQRADGAWCGEVHSNATFTSQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFHSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDCQLENRLRASSQLAIAYLLGCQENNGSWWGRWGVNYLYGTSNVLCGLAYYYDRSSLSKGDVKSNSNIVSAVDRASEWLKARQHSNGGWGEGPESYDNAQLAGCGQPTASQSAWVTMALLNYLSPTDEVIQRGVSYLVRNQVKYGDESRATWLLERYTATGFPGHLYMEYDYYRHYFPIMALGRYVNKLSGSHKLL

SEQ ID NO: 15 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVAISIVMSRQPVFPLPERARVPELYDTDVPPRRRGAKGGGGRIFDALDRALHGYQKLSVHPFRRAAEIRALDWLLERQAGDGSWGGIQPPWFYTLIALKILDMTQHPAFIKGWEGLELYGVDLDYGGWMFQASISPVWDTGLAVLALRAAGLPADHDRLVKAGEWLLDRQITVPGDWAVKRPNLKPGGFAFQFDNVYYPDVDDTAVVVWALNSLRLPDERRRRDVMTKGFRWIVGMQSSNGGWGAYDVDNTSDLPNHIPFCDFGEVTDPPSEDVTAHVLECFGSFGYDDAWKVIRRAVEYLKREQRPDGSWFGRWGVNYLYGTGAVVPALKAVGIDVREPFIQKALDWVEQHQNPDGGWGEDCRSYEDPAYAGKGASTPSQTAWALMALIAGGRAESDSVRRGVQYLVETQRPDGGWDEPYYTGTGFPGDFYLGYTMYRHVFPTLALGRYKQAIERR

SEQ ID NO: 16 - protein, 631 aa, Alicyclobacillus acidocaldarius [sequence omitted]

SEQ ID NO: 17 - protein, 227 aa, Alicyclobacillus acidocaldarius
QASISPVWDTGLAVLALRAAGLPADHDRLVKAGEWLLDRQITVPGDWVVKRPNLNPGGFALQFDNVYYPDVDDTAVVIWALNTLRLPDERRRRDAMTKGFRWIVGMQSSNGGWGAYDVDNTSDLPNHIPFCDFGEVTDPPSEDVTAHVLECFGSFGYDDAWKVIQRAVAYLKREQKPDGSWFGRWGVNYIYGTGAVVSALKAVGIDMREPYIQKALDWVEQHQNPDG

SEQ ID NO: 18 - protein, 634 aa, Alicyclobacillus acidoterrestris
MTKQLLDTPMVQATLEAGVAHLLRRQAPDGYWWAPLLSNVCMEAEYVLLCHCLGKKNPEREAQIRKYIISQRREDGTWSIYPGGPSDLNATVEAYVALKYLGEPASDPQMVQAKEFIQNEGGIESTRVFTRLWLAMVGQYPWDKLPVIPPEIMHLPKSVPLNIYDFASWARATIVTLSYRHESPTCDATSGLCKGSGIVRGEGPPKRRSAKGGDSGFFVALDKFLKAYNKWPIQPGRKSGEQKALEWILAHQEADGCWGGIQPPWFYALLALKCLNMTDHPAFVKGFEGLEAYGVHTSDGGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTKSDSIFATSGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGEDCRSYDDPRLAGQGVSTPSQTAWALMALIAGGRVESDAVLRGVTYLHDTQRADGGWDEEVYTGTGFPGDFYLAYTMYRDILPVWALGRYQEAMQRIRG

SEQ ID NO: 19 - protein, 236 aa, Alicyclobacillus acidoterrestris
GGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTNRIPFCNFGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGE

SEQ ID NO: 20 - protein, 637 aa, Anabaena variabilis
MRTQDRVQVNSIAEAIAASQKYLLSLQNPTGYWWAELESNVTITAEVVLLHKIWGTDKTRPLHKIEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPAITLDELYAEGVENVRYELPRSGDWTDLFLTLDEGFKLAESFNFIPFREEGIKAAEKWIIERQEATGDWGGIIPAMLNSMLALRVLGYATNDPIVERGLQAIDNFAIETADCYRVQPCVSPVWDTAWVIRALIDSGMAPDHPAIVKAGEWLLQKQIFDYGDWNVKNRQGQPGAWAFEFDNRFYPDVDDTAVVVMALHAAKLPHEQLKQKACDRALQWVASMQCKPGGWAAFDIDNDQDWLNAVPYGDLKAMIDPNTADVTARVIEMLGACNLSIDSHDLERALTYLLNEQEAEGCWFGRWGVNYIYGTSGVLCALALINPQKYQRHIQQGATWLVGCQNPDGGWGETCFSYNDPSLKGQGDSTPSQTAWALIGLIAAGEATGNFAHDVIERGINHLVSTQQPDGSWFEAYFTGTGFPCHFYLKYHYYQQYFPLIALGRYQAINPL

SEQ ID NO: 21 - protein, 654 aa, Anaeromyxobacter sp.
MSGEVRVAGDALAEDAGRAAAAASQYLYRTQQRDHWRAELESNVTVTAEYVLLRQALGLDLEERRDALVRYLCSRQKADGSFGIASTLPGDVSTTAEAYLALRLLGLDREDERLRAAERFIRGAGGLARVRVFTRINLALFGLFPWEAVPTVPAELIFLPRWAPVNVYRLASWARSTMVPLFVLFHHRPVFALPGGAGSDWLDHLWLGPGDKRVPYRTSVMETVRRHGPGWKAFFNAADAWLRVHDRLRHLPPLGRLRTEALRACEEWILARQEASGDWAGIFPPMLNGVLALHVAGHGLDAAPVRRGLEAIERFAVSDREGFRIEACQSPVWDTILALIGLLDSGESPTDPRLVAARRWIEGMQLTNDWGDWKVYDPRGEPGGWAFEYANSWYPDVDDTAAVIVGLLKHDPASRAGETVRRAAAWVASMQNRDGGWAAFDVNNDRLFLNEIPFSDMDSLCDPSSPDVTGRVLEAFGMLDAPHLRAACRRGVAYLRRAQEPEGSWYGRWGVNYVYGTSNVLNGLARQRVPASDPMVARALGWLDSVQNADGGFGEGLESYADRAAMGRGPSTASQTAWGVMGLLAYRAADDAAVRRGIAWLVERQLADGEAQGSWEEEAFTGTGFPRHFYLRYHLYRHYFPLMALGRFCAQGRG

SEQ ID NO: 22 - protein, 710 aa, Aspergillus clavatus
MATLTTMATTATMATTEASQPLEAQARTALTKATSYAWEIISNRHWCGELESNVTVTCEHIFFLYVLYQHIDPDEGSQYRQWLLSQQNADGSWGIAPNYPGDVSTSAEAYLALRIIGMSPDSPELFQARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSLDPTDPLSFVFTILDKALSYLGGLRRCPTRGYARRRCIQWILQHQEKAGDWAGIIPPMHAGIKALWLEGYKLHDEPIQLGLAAIERFTWTDNRGKRLQCCISPVWDTVLMIRALQDTPASLGIKSDPRIADALAWTAENQHRGPEGDWRVYQPNIPVGGWAFEYSNTWYPDIDDTAAAVLAFLTHDPATARSRLVRDAVLWIVGMQNADGGWAAFDHENNRLFLNKIPFSDMESLCDPSTPDVTGRTIECLGMLRDLLMLPAEKAGKKGEKYGYPDGERDAAADSHLLKIINTACARAIPYLIRTQEATGAWYGRWAVNYVYGTCLVLCGLQYFKHDPTFAPEIDTMATRAVKWLRQIQNSDGGWGESVLSYREPWRAGCGPSTPSQTAWALMGLLTVCGGEDRSVQRGVRHLVDTQDDILSKGEGGAAAWTEREFTSTGFPNHFYISYTLYRVYFPITALGRYLSLVEGGKKENGGGA

SEQ ID NO: 23 - protein, 673 aa, Aspergillus flavus
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDPTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 24 - protein, 738 aa, Aspergillus fumigatus
MLGAIREPPIDVQIALHSRDDNQTGLVLRGTRRTVDRVLKGLCSSPCFFCSVSLTMATLTTTMATTATMATTEASKPLEAQARTALTKATNYAWEIFSNRHWCGELESNVTVTCEHIFFLYVLYQHIDPGEGSQYRQWLLSQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTVLMIRALQDTPASLGIKLDPRIADALAWTAENQHRGPEGDWRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTIREPLHEASQRIGSD

SEQ ID NO: 25 - protein, 689 aa, Aspergillus fumigatus
MLQTEAITTEGLRVRSLSPDDPLLPRIKQAIKLSGQHSRGEMHSDGHWCGEVKTNATTSAEHVLLCQALGINLDADREAFISWFRCTQGADGGWSTAPDQAGDISVTVEAYLALKILGLSEDDAAMRRARDFAIAAGGVAKVRIFTRIYLALFGLFPWAAVPELPPELILLPSRVPVSIYHWSAWARATVVPLLIISHHRPIYALPGGGKGTSSDYLDELWCDPQNKMIPYNHDEPTAWRSDPFASIFTLADSILHRLDGLRSFNPFRRFALQKCVDWILEHQEDMGDIGDIMPPLHGAMLALRLEGYPLHSGPIHRGLEAIERFAYRDKQGKRIQTTVSAFWDTSLMLIALGDAGMASKPWLTRSLGWLQQHQRLGNYGDWKVNNHGLKAGGFSFGYFNTWYPDVDDTASAVLAMIRQDERLVHSASVLDALNWLLGMQNTDGGWGAFDRDNDKHFLNKIPFSDMDALCDPSTPDVTGHVLEAFGLFLALSKADALADRVVAASRRAIRYLSDTHVLSRGWYGRWGCNYIYGTSAVLCALAYFGSENDALSGVRVMKDAINQAIRWLETVQNPDGGWGETVDSYKDPSRAGSGPSTASQTAWAIMALLPYLPPSTEVIQRGMEYLLRTQTKTASQGATWHEKAYTATGFPKYFYMGYSLYAHYFPMMALGRYAYPCPAWHENWRLKRD

SEQ ID NO: 26 - protein, 671 aa, Aspergillus fumigatus
MATLTTTMATTATMATTEASKPLEAQARTALTKATNYAWEIFSNRHWCGELESNVTVTCEHIFFLYVLYQHIDPGEGSQYRQWLLLQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTSTGFPNHFYISYTLYRVYFPITALGRYLSLIEGGQEKKKKGGGT

SEQ ID NO: 27 - protein, 693 aa, Aspergillus niger
MAHQETMASETSISLHTLACDATKLAGTYALRQVREDGHWYGEMKSNATITAEYVFLAQALGFSIEEDRDDLIKYFLSEQNTDGSWSLAYDFPGDVSVTAEAYFALCLLGLDRSHPAMASAREFTLSKGGIAKVRVFTRMFFACFGLFPWSAVPELPAELILLPAAAPMSIYQLASWARATVVPMLVIRHHRPIYALPNGRSSSNEYLDELWVDPTDKMVPYSPSLWSLWNDDLTAFGFTLADNILKALGGLRWFPSRKIALRHCVAWILERQEPEGDIGGIFPPLHAALFALALEGYGLESSPVRRGIDALQNTYAWRDSTGLRIQGCISPILDTILMTIGLIDSSLPAESPLVARSSRYLKAHQQLGNEGDWRVYNGNVPSGGFNFEYFNSWYPDIDDTAAAILAMVKQDPNLLDLGPILSAVQWILGLQNDDGGWAAFDRENNYLFLNKIPFSDMDSFCDPSTADVTGRVIECFGLNGKNPIPRFFIDDMSSATERAIDFLSTEQEADGSWYGRWGSNYIYGTSAVLCGLVYHLEGWDDTYPVMEKRHKVDTHAALDWLKRHQNPDGGWGERLESYYEPRLAGNGPSTASQTAWALMGLLAYLAPTDESITRGIQYLSRTQIKEGELAGSWKEDHYTGTGFPNHFYLCYTLYSQYFPMMALGRYTSLSGYRPLENLESTVEDHKGNSSDC

SEQ ID NO: 28 - protein, 653 aa, Aspergillus niger
MMTLREEGHKEGITPGKEQLTSDIEHSLKLATEYALSSIRSDGHWCGELRSNVTITAEYIFLRHALGLDLRTDNAAYCRYILSQQNCDGSWGLAPEYPGDVSTTTEAYLALKLLGTSPDMPAMQQARAFVRKAGGAEKVRVFTRIFLATFGLFPWDAVPQLPVELILLPSSCPINMYTLASWARGTIAPLLIICHHQPVYALPEDYLDELWLDPTDKNVPYGSSLRDLLSRGDITGLAFSVVDNLLYYLNGLRSVPLLRSYARRKCIQWILERQEPTGDWAGIFPPMHASIYAFVLEGYELNDPPVRLGIQALENFAWEDEKGKRIQACVSPVWDTALMSIGLCDAMSPDKQILQQAITWIRNRQLLKPCGDWRIYRSKLAPGGFSFEYENSHYPDVDDTAAIILAQLKQDPQSVASDSVIAAATWILGMQNPDGGWAAFDVENDKLFLNKIPFSDMDSLCDTSCADITGRILEAFGLMMKRELKRPVLSPMLRHACIRGITYLASTQESNGAWFGRWGCNYIYGTCHALGLVAPALQWLKSKQNDDGGWGEPLLSYRTPGTQLQQQSTPSQTAWALMGLLAHLPLTDPAIERGIRWLVCSQQPEKGNGASWPEAVYTGTGFPNHFYLGYDYYRHYFPMMALGRYLQASQAQA

SEQ ID NO: 29 - protein, 673 aa, Aspergillus oryzae
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDSTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 30 - protein, 659 aa, Azotobacter vinelandii
MERSSLLVPASIDSHSRESETTGLDQAIVRARAALLGRQGADGHWCFELESDCTITAEYILMMHFTDEIDEDLQERMARYLRATQVQETHGGWPQYVGGAIDLSCTVKAYYALKAAGDSPEAPHMRRAREAVLALGGAAKSNVFTRILLAMFEQVPWRAVPYLPVEIMLLPRWAPIHIEKMSYWARTTLVPLTILCSLKARAANPKRVDIRELFVTAPEQERHYFLRGGLLNRIFLGLDKFARTLDRWMPKSLRQHAIRKAEAWFLPRMNGEDGLGAIFPPMVNCYEAMILLGYPKDHPARKTCLRSIQKLIVHRDDGSAYCQPCVSPVWDTAWSAMALIHSGDDTATQTAIARAGDWLVQRQELDCRGDWEAQAPQAAPGGWAFQYANGYYPDIDDTALVAALLHISDRRRGQPGQHAFNIDRAVDWMLALQSRNGGFAAFDADNTHYYLNAIPFADHGALLDPPTEDVSGRVAACLGILKRDQDRDGLRRCIDYLRTTQQPDGSWWGRWGSNYIYGTWSALSGLALAGEDLRQPYLRKSVDWLRTRQHPDGGWGETNDSYIDPHLAGTNAGISTPHSTAWAVLAQLAMGEVESDSVRRGIAFLLACQQTDGLWSHPSHNAPGFPRVYYLKYHGYAAYFPLYALARYRHLLNRSREQR

SEQ ID NO: 31 - protein, 627 aa, Bacillus amyloliquefaciens
MSTIHENVRSRQKKTISLLRETQNADGSWSFCFEGPILTNAFLILLLTSLGDNDKELIAELAEGIRAKQRPDGTFANYPDDRKGNVTATVQGYAGLLASGLYSRSEAHMIQAERFIISNGGLRNVHFMTKWMLAANGLYPWPALHLPLSFLVIPPTFPLHFYQFSTYARIHFVPMAVTLNKRFSLKNPNVSSLAHLDRHMTKNPFTWLRSDQDENRDLSSLFAHWKRLLQIPAAFHQLGLRTAKTYMLDRIEEDGTLYSYASATIFMVYGLLALGVSRHSPVLRKALAGTKALLTSCGNIPYLENSTSTVWDTALLNYALMKSGISDNDQMITSAARFLRERQQKKVADWAVHNPHAEPGGWGFSNINTNNPDCDDTAAVLKAIPRKLYPASWERGLSWLLSMQNSDGGFSAFEKNVNHPLVRLLPLESAEEAAIDPSTSDLTGRVLHCLGEAGLSSDHPQIEKAVQWLIRHQEEDGSWYGRWGVCYIYGTWAALTGMKACGVSQNHPAVKKAIRWLKSIQNEDGSWGESCKSAEEKTYVPLSYGTLVQTAWAAEALLQYEKTHHQAVTKGISFLIENRHYEGAAFSYPTGIGLPKQFYIRYHSYPYVFSLLALSTFMKMSEKEEEK

SEQ ID NO: 32 - protein, 617 aa, Bacillus anthracis
MLLYEKAHEEIVRRATALQTMQWQDGTWRFCFEGAPLTDCHMIFLLKLLGRDKEIEPFVERVASLQTNEGTWKLHEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYLYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 33 - protein, 631 aa, Bacillus cereus
MNIVIRISKGWVSNLLLYEKVHEEIARRTTALQTMQRQDGTWQFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAIHGEYEYPSLFHLPTPIMFLQNDSPLSIFELSSSARIHLIPMMVCLNKRFQVGKKLLPNLNHIAGGGGEWFREDRSPMFQTLLSDVKQIISYPLSLHHKGYEEVERFMKERIDENGTLYSYATASFYMIYALLALGHSLQSSMIQKAIAGITSYIWKMEKGNHLQNSPSTVWDTALLSYTLQEAHASKDNKMIQHAAAYVLKKQHTKKADWSVHAPGLIPGGWGFSDVNTTIPDVDDTTAVLRALARSRGNENVDNAWKKGVNWVKGLQNNDGGWGAFEKGVTSNLLANLPIENASDMITDPSTPDITGRVLELFGTYAQNELPEKQKQSAINWLMNVQEENGSWYGKWGICYIYGTWAVMTGLRSLGIPSSNPSMKRAALWLEHIQHEDGGWGESCQSSVEKRFITLPFSTPSQTAWALDALISYHDEETPAIRKGISYLLANPYVNEKYPTGTGLPGGFYIHYHSYAYIYPLLTLAHYIKKYRK

SEQ ID NO: 34 - protein, 631 aa, Bacillus cereus
MNIVIRISKGWVSNLLLYEKVHEEIARRTTALQSMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSLQSSMIQKAIAGITSYMWKMESGNHVQNSPSTVWDTALLSYALQEAHVLKDNKMLQNATAYLLKKQHTKKADWSVHAPALTPGGWGFSDVNTTVPDVDDTTAVLRVLARSRGNEKVDHAWQKGINWVKGLQNNDGGWGAFEKGVTSHILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYDKETSVIRKGISYLLSNPYINETYPTGTGLPGGFYIRYHSYAHIYPLLTLAHYAKKYRK

SEQ ID NO: 35 - protein, 620 aa, Bacillus cereus
MSNLLLYEKAHEEIVRRATALQTMQWQDGTWRFCFEGAPLTDCHMIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHLPTPIMFLQDDAPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLKRAASWLEHIQHEDGGWGESCHSSVEKRFVTLPFSTPSQTAWALDALISYYDTETPAIRKGVSYLLLNPYVNERYPTGTGLPGAFYIRYHSYAHIYPLLTLAHYLKKYRK

SEQ ID NO: 36 - protein, 620 aa, Bacillus cereus
MSNLLLYEKVHEEIARRATALQTMQRQDGTWRFCFEGAPLTDCHMIFLLKLLGRDKEIEPFVKRLASLQTNEGTWKLYEDEVGGNLSATIQSYAALLASQKYTKEDANMKRAENFIKERGGVARAHFMTKFLLAIHGEYEYPSLFHVPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSMIQKAIAGITSYIWKMERGSHLQNSPSTVWDTALLSYALQEAQVPKDHKMIQQTITYLLKKQHTKKADWSVHAPALTPGGWGFSDVNTTVPDVDDTTAVLRVLARSRENEKVNNAWQKGIDWVKGLQNNDGGWGAFEKGVTSKLLANLPIENASDMITDPSTPDITGRVLELFGTYTQNELPEKQKQSAINWLMNAQEENGSWYGKWGICYIYGTWAVMTGLRSLGIPSNNPSLKRAALWLEHIQHEDGGWGESCQSSMEKRFITLPFSTPSQTAWALDALISYYDTETPAIRKGISYLLANPYVNEKYPTGTGLPGGFYIRYHSYAQIYPLLTLAHYTKKYRK

SEQ ID NO: 37 - protein, 620 aa, Bacillus cereus
MSNLLLYEKAHEEIARRATALQTMQREDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKKYRK

SEQ ID NO: 38 - protein, 620 aa, Bacillus cereus
MSNLLLYEKAHEEIARRATALQSMQWQDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAVHGEYEYPSLFHLPTPIMFLQNDSPLSIFELSSSARIHLIPMMLCLNKRFRVGKKLLPNLNHIAGGGGEWFREERSPLFQTLVSDVKQIISYPLSLHHKGYEEVERFMKERIDENGTLYSYATASFYMIYALLALGHSLQSSIIQNAITGITSYIWKMESGNHLQNSPSTVWDTALLSYALQEAHVPKDNKMLQNATAYLLKKQHTKKADWSVHASALTPGGWGFSDVNTTVPDVDDTTAVLRVLARSRGNEKVDHAWQKGINWVKGLQNNDGGWGAFEKGVTSNILAKLPIENASDMITDPSTPDITGRVLEFFGTYAQNELPEKQKQSAINWLMNVQEENGSWYGKWGICYIYGTWAVMTGLRSFGIPSSNPSLKRAALWLEHIQHKDGGWGESCHSSVEKRFVTLPFSTPSQTAWALDALISYYDTETPIIRKGISYLLANPYVNEKYPTGTGLPGGFYIRYHSYAHIYPLLTLAHYIKKYRK

SEQ ID NO: 39 - protein, 620 aa, Bacillus cereus
MNNLLLYEKVHEEIARRATALQTMQQQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSHLSIFELSSSARIHLIPMMLCLNKRFRVGKKLLPSLNHIAGGGGEWFREDRSPLFQTLVSDVKQIISYPLSLHHKGYEEVERFMKERIDENGTLYSYATASFYMIYALLALGHSLQSTMIQKAITGITSYIWKMESGNHLQNSPSTVWDTALLSYALQEAHVPKDNKMIQHAATYLLKKQHTQKADWSVHAPALTPGGWGFSDVNTTIPDVDDTTAVLRALARSRGNEKVDNAWPKGINWVKGLQNNDGGWGAFEKGVTSNILANLPIENASDMITDPSTPDITGRVLEFFGKYAQNELPEKQKQSAINWLMNVQEENGSWYGKWGICYIYGTWAVMTGLRSLGIPSSNPSMKRAALWLEHIQHEDGGWGESCHSSVEKRFVTLPFSTPSQTAWALDALISYYDKETSIIRKGISYLLANPYVNEKYPTGTGLPGGFYIRYHSYAHIYPLLTLAHYIKKYRK

SEQ ID NO: 40 - protein, 620 aa, Bacillus cereus
MSNLLLYEKVHEEIARRTTALQTMQRRDGTWRFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAVHGEYEYPSLFHLPTPIMFLQSDSPLSIFELSSSARIHLIPMMLCLNKKFRIRKKLLPNLNHISGGGGEWFRGNRSPLFQTLVSDVKQIISYPLSLHHKGNEEVERFMKERIDENGTLYSYATASFYMIYALLALGHSLQSTMIQKAITGITSYIWNMESGNHLQNSPSTVWDTALLSYALQEAHVPKDTNMLQHATAYLLKKQHTKKADWSVHAPALAPGGWGFSDVNTTIPDVDDTTAVLRALARSRGSEKVDYVWEKGINWVKGLQNNDGGWGAFEKGVTSNLLANLPIENASDMITDPSTPDITGRVLELFGTYAQNELPEKQTQSAINWLMNVQEKNGSWYGKWGICYIYGTWAVMTGLRSLGIPSSNPSLKRAALWLEHIQHEDGGWGESCHSSVEKRFVTLPFSTPSQTAWALDALISYYDKETPAIRKGISYLLANRYVNEKYPTGTGLPGGFYICYHSYAHIYPLLTLAHYIKKYRK

SEQ ID NO: 41 - protein, 620 aa, Bacillus cereus
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYVLQEAQVPKASKVIHNASAYLLRKQQTKKVDWSVHAPDLFPGGWGFSDVNTTIPDIDDTTAALRALARSRGNENVDTAWKRAVNWVKGLQNNDGGWGTFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 42 - protein, 620 aa, Bacillus cereus
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIEKAIMGITSYIWKVERGSHLQNSPSTIWDTALLSYALQEAQVPKASKVIQNASAYLLRKQQTKKVDWSVHAPDLFPGGWGFSDVNTTIPDIDDTTAVLRALARSRGNEHVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 43 - protein, 620 aa, Bacillus cereus
MNALLLYEKVHEEIARRTTALQTMQRQDGTWRFCFEGAPLTDCHMIFLLKLLGRDKEVEPFVKRLASLQTNEGTWKLYDDEMGGNLSATIQSYAALLASKKYTKEDANMKRAEMFITERGGVARAHFMTKFLLAIHGEYEYPSLFHLPTPIMFLQNDSPLSIFELSSSARIHLIPMMLCLNKRFRVGKKLLPNLNHIAGGGGEWFREDQSPMFQTLLGNVKQIISYPLSLHHKGNEEVERFMKERIDENGTLYSYASASFYMIYALLALGHSIQSPMIQKAITGITSYIWKMERGNHLQNSPSTVWDTALLSYALQEARVSKESKMIQNASAYLLKKQHKKKADWSVHAPVLIPGGWGFSDVNTTVPDVDDTTAVLRALAQSRGNGNVDDAWKKGTNWIKGLQNNDGGWGAFEKGVTSKLLANLPIENASDMITDPSTPDITGRVLEFFGTYTQNELPEKQKQSAINWLMNEQEENGSWYGKWGICYIYGTWAVMTGLRALGITSAHPSLKRATLWLEHIQHEDGGWGESCQSSVEKRFATLPFSTPSQTAWALDALISYYDKETPAIRKGISYLLANPYVNEKYPTGTALPGGFYIHYHSYAHIYPLLTLAHYAKKYKK

SEQ ID NO: 44 - protein, 620 aa, Bacillus cereus
MSGVLLYDKVHEEIERRTTALQTMQRQDGTWQFCFEGALLTDCHMIFLLKLLGRNDEIEPFVKRLASLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSLLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPSLKKAASWLEHLQHEDGGWGESCQSSVEKKFISLPFSTPSQTAWALDALISYYDQETPIIRKGITYLLAQSTMNEKYPTGTGLPGGFYIRYHSYGHIYPLLALAHYVKKYRK

SEQ ID NO: 45 - protein, 620 aa, Bacillus cereus
MSGVLLYDKVREEIERRTTALQTMQRQDGTWSFCFEGALLTDCHMIFLLKLLGRNDEIEPFVKRLASLQTNEGTWKLYEDENGGNLSATIQAYAALLASEKYSKEDINMRRAEMFIKEHGGVSRAHFMTKFLLAIHGEYEFPTLFHFPTPILFLQDDSPLSIFELSSSARIHLIPMMICMNKRFRVEKKLLPNLNHIAGEGGQWFREERSPLFQSFVGDVKKVIAYPLSLHHKGYEEVERFIGERIDENGTLYSYASATFYMIYALLALGHSIQSPIIEKAVIGLKSYIWKMDRGSHLQNSPSTVWDTALLSYSLQEANVMKENKMIQKATEYLLQRQQTKRMDWSVHAPSIMAGGWGFSDVNTTIPDVDDTTAALRALARSRGSSRVDSAWERGVEWLKGLQNNDGGWGAFERGVTSRILANLPIENASDMITDPSTPDITGRVLEFFGTYAPNELPEEQKKKAVKWLMDVQELNGSWYGKWGICYIYGTWAAMTGLRALGVPSSHPSLKKAASWLEHLQYEDGGWGESCQSSVEKKFISLPFSTPSQTAWALDALISYYDQETPIIRKGISYLLAQPTMNEKYPTGTGLPGGFYIRYHSYGHIYPLLALAHYIKKYKK

SEQ ID NO: 46 - protein, 619 aa, Bacillus cereus
MLLYEKVHEEVKEKMAALQAMQQQDGTWRFCFEGSPLTDCYMIFLLTLLGQDQEIEPFVARLAALQTNEGTWKLYEDEPDGNLSATIQAYAALLVSKMYKKEDINMKRAEVFIRKQGGITKAHFMTKFLLALHGGYEYPPLFHFPTPILFLSEDSPLSIFELSSSARIHLIPMMLCMNKRFTVSKKMLPNLDYISGGSKEQWFREERSPLFQTLLRDVTKFLSYPLSLHYKGDKAAERFMIERIDTNGTLYSYASATFYMIYALLALGHSIQSPLISNAVLGLKTYVWNMDRWAHLQNSPSTVWDTALLSYSLQEARVPHDNEMIQKAINYLLQKQHKEKKDWSVHAPTLDAGGWGFSDVNTTIPDVDDTTAVLRALAGSRQGNPKVESAWRKGIEWVKGLQNSDGGWAAFEKGVTSKVLTHLPLDNSGDMITDPSTVDITGRVLEFFGTYAPNELQGDQKDRAIRWLIYTQEKNGSWHGKWGVCYIYGTWAALTGLRAVGVPSNHIALQKAATWLESIQHSDGGWGESCRSSVEKKFISLPFSTPSQTAWALDALIACYDSETPTIRKGISYLLKHSTKHQEYPTGTALANGFYIRYHSYHHIFPLLTFAHYIKKYRK

SEQ ID NO: 47 - protein, 617 aa, Bacillus cereus
MLLYEKVHEEIVRRATALQTMQWQDGTWRFCFEGAPLTDCHMIFLLKLLGREKEIEPFVERIASLQTNEGTWKLYEDEVGGNLSATIQSYAALLASKKYTKEDANMKRAENFIKERGGVARAHFMTKFLLAIHGGYEYPSLFHLPTPIMFLQNDSPLSIFELSSSARIHLIPMMLCLNKRFRVGKKLLPNLNHIAGGGGEWFREDRSPVFQTLISDVKQIISYPLSLHHKGYEEIERFMKERIDENGTLYSYATASFYMIYALLALGHSPQSSMIQKAIAGLTSYIWKMGRGSHLQNSPSTVWDTALLSYALQEARVSKDNKMIQNATAYLLKKQHTKKADWSVHAPALIPGGWGFSDVNTTIPDIDDTTAVLRALARSRGNKNIDNAWQKGVNWIKGLQNNDGGWGAFEKGVTSKLLANLPIENASDMITDPSTPDITGRVLEFFGTYAQNGLPEKQKQSAINWLMNAQEENGSWYGKWGICYIYGTWAVMTGLRSLGIPSSNPSLKRAASWLEYIQHEDGGWGESCHSSVEKRFVTLPFSTPSQTAWALDALISYYDTETPAIRKGVSYLLSNPYVNERYPTGTGLPGAFYIRYHSYAHIYPLLTLAHYLKKYRK

SEQ ID NO: 48 - protein, 617 aa, Bacillus cereus
MLLYEKAHEEIARRATALQTMQRQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSLIQKAIAGITSYIWKMERGSHLQNSPSTVWDTALLSYALQEAHVPKDHKMIQQTITYLLKKQHTKKADWSVHALALTPGGWGFSDVNTTIPDVDDTTAVLRALARSRGNENIDNAWKKGVNWIKGLQNNDGGWGAFEKGVTSKLLANLPIENASDMITDPSTPDITGRVLELFGTYTQNELPKKQKQSAINWLMNVQERNGSWYGKWGICYIYGTWAVMTGLRSLGIPSNNPSLKRAALWLEHIQHEDGGWGESCQSSVEKRFVTLPFSTPSQTAWALDALISYYDKETPTIRKGVSYLLANPYVNEKYPTGTGLPGGFYIRYHSYAQIYPLLTLAHYTKKYQK

SEQ ID NO: 49 - protein, 617 aa, Bacillus cereus
MLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 50 - protein, 486 aa, Bacillus coahuilensis
MAEAISYPRRVHIITTKFPVNFYDFSVFGRSNIAPILLLADSKFQIPKTTETPDISHLYVRELYWWSEDRGWNGFTKAINKGVNNLIGLPNELHTLGRKQAENYMLDRLEDDGTLLSYYSSTFFMIYALLSVGYTKDHKVIKKAARGLLSMNTTVKDTIHIQYTTAHIWNTSLISHALQTAGASPDDTMVMRANHYLLQRQHTKFGDWAIYQPNLGPGGWGFSHSNTFNPDVDDTTASLRSIQNSLHSHPNYQSSWYRGLSFTLGMQNQDGGFPAFEKGVDKTFLHLLPVQGAEFLLTDPSTPDLTGRTLEFLGESAHLYKDSGAIKRGVNWLIENQRRDGSWYGRWGICYIYGTWAALTGLQAVGVSKEHPSVQEGIDWLKSIQQDDGGWGESCESDSQKTYIPLSKSTVTQTAWAVDALIAYEKEETVEIKKGMEYLLENWNHEDWTMDYPMGQGMAKAFYIHYHSYRYVFPLLTMGHYMRKFM

SEQ ID NO: 51 - protein, 619 aa, Bacillus cytotoxicus
MVLYGRVCAEIERTITALHTMQQQDGAWRFCFEGSPLTDCHMIFLLRLLEKEEEIEPFVARLTSIQTNEGTWKLYEDERAGNVSTTIQAYAALLASGMYTKEDVNMKRAEAFIQERGGIARSHFMTKFLLALHGGYEYPRMFYFPTPILFLPEDSPLSIFELSSSARIHLIPMMICMNKRFTVSKTILPNLDHISGSSKSEWFREDRSSLFETILGEVKKFVTYPLSLHHKGDKEAERFMIERIDRNGTLYSYASATFYMIYALLALGHHIQSPLIQQAVAGLRTYKWHMEAGIHLQNSPSTVWDTALLSYALQEANVNESTPMIQTATEYIWQRQHHEKKDWSLHAPTLSPGGWGFSDVNTTIPDVDDTTAALRALARSRKRNRRIEEAWKKGVNWVKGLQNKDGGWAAFEKGVTNRFLTHLPLENSGDMMTDPSTADITGRVLEFFGTYAPNELQDHQKNRAITWLMDVQENNGSWYGKWGVSYIYGTWAALTGLRAVGVANTHPALKKAVMWLERIQHRDGGWGESCRSSIEKRFVPLSFSTPSQTAWAIDALISYYDEETPVIRKGISYLLEHAASHQEYPTGTGLPNGFYIRYHSYSYMYPLLTFAHYINKYRK

SEQ ID NO: 52 - protein, 629 aa, Bacillus licheniformis
MRSILEDVKAFRQKTLAELQNRQRSDGSWRFCFEGPVMTDSFFILMLTSLGDQDSSLIASLAERIRSRQSEDGAFRNHPDERAGNLTATVQGYTGMLASGLYDRKAPHMQKAEAFIKDAGGLKGVHFMTKWMLAANGLYPWPRAYIPLSFLLIPSYFPLHFYHFSTYARIHFVPMAITFNRRFSLKNNQIGSLRHLDEAMSKNPLEWLNIRAFDERTFYSFNLQWKQLFQWPAYVHQLGFEAGKKYMLDRIEEDGTLYSYASATMFMIYSLLAMGISKNAPVVKKAVSGIKSLISSCGKEGAHLENSTSTVWDTALISYAMQESGVPEQHSSTSSAADYLLKRQHVKKADWAVSNPQAVPGGWGFSHINTNNPDLDDTAAALKAIPFQRRPDAWNRGLAWLLSMQNKDGGFAAFEKDVDHPLIRNLPLESAAEAAVDPSTADLTGRVLHLLGLKGRFTDNHPAVRRALRWLDHHQKADGSWYGRWGVCFIYGTWAALTGMKAVGVSANQTSVKKAISWLKSIQREDGSWGESCKSCEAKRFVPLHFGTVVQSSWALEALLQYERPDDPQIIKGIRFLIDEHESSRERLEYPTGIGLPNQFYIRYHSYPFVFSLLASSAFIKKAEMRETY

SEQ ID NO: 53 - protein, 620 aa, Bacillus mycoides
MSGVLLYDKVHEEIERRTTALQTMQRQDGTWQFCFEGALLTDCHMIFLLKLLGRNDEIEPFVKRLVSLQTNEGTWKLYEDEKGGNLSATIQAYAALLASERYSKEAMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 54 - protein, 619 aa, Bacillus mycoides
MLLYEKVRQEVERKVTALRTTQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTIFPNLDYISGGSKKQWFREERSPLFQTLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEDWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAVLTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 55 - protein, 619 aa, Bacillus pseudomycoides
MLLYEKVRQEVERKVTALRTMQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTILPNLDYISGGSKKQWFREERSSLFQRLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEAWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAALTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 56 - protein, 624 aa, Bacillus pumilus
MQDFKTKVNVYMDELHMQMQHRQREDGAFVFCFEGSMMTNAFLIMLLKAVGDTDQALVHQLAEAIREKQNEDGSFSLYHDQAGHVTATVQGYCGMLVSGRYQQDEPHMEKAARYIRSKGGLKDVHFMTKWMLAVNGMHPWPYFYAPLSFLLIPTYFPLHFYHLSAYARIHFVPMMIALNKRYTSHEQFPSLSHLDANMSKNPFDWFMAREERSTHHFLAYMRSYTALDSRFDFFGYEAAKRYMFDRLEKDGTLYSYLSASIFMVYALMSLGYSPGHHLILKAVKGMKQLVTDCGGKKYAENSTSTVWDTALVSYASQRAGRTQDDPVIKKSFTYLLNRQQMKKADWAIHNRHAAPGGFGFSDLNTNNPDCDDTQIVLKAIPQTYAPVQWKRGFDWLLSMQNRDGGFSAFEKNQDHFLLRHLPLESAEDAAIDPSTPDITGRVLHLIASEENDKSPLMQRQKDHCVKWLLDHQEKDGSWYGRWGVCYIYGTWAALTGLKASGIPSSHPAVQKACRFLKTIQLEDGSFGESCKSSEVKRYVPLPFGTVVQTAWAAEALLQYVQPDDKSILKAISFLIQHQHSSKALHYPVGIGLPKQFYITYHSYPFVFPMMACSTFLEEMRRKNE

SEQ ID NO: 57 - protein, 624 aa, Bacillus pumilus
MQDFKTKVNEYIDELHMQLQRRQREDGAFVFCFEGPMMTNAFLIMLLKAVGDSDQALVHQLAEAIREKQNEDGSFSLYHDQAGHVTATVQGYCGMLVSGRYQQDEPHMEKAAHFIRSNGGLKDVHFMTKWMLAVNGMHPWPYFYAPLSFLLIPTYFPLHFYHLSAYARIHFVPMMIALNKRYTSHEQFPSLAHLDANMSKNPFDWFMAREERSTHHFLAYMRSYTALDSRLDFFGYEAAKRYMFDRLEKDGTLYSYLSASIFMVYALMSLGYSPGHHLILKAVKGMKQLVTDCGGRKYAENSTSNVWDTALVSYASQQAGRTQDDPVIKKSFTYLLNRQQMKKADWAIHNRHAAPGGFGFSDLNTNNPDCDDTQIVLKAVPQTYAPVQWKRGFDWLLSMQNQDGGFSAFEKNQNHFLLRHLPLESAEDAAIDPSTPDIAGRVLHLIALEENSMSPLMQRQKDHCVKWLLDHQEKNGSWFGRWGVCYIYGTWAALTGLKTAGISSSHSAVQKACRFLKTIQLEDGSFGESCKSAEVKRYVPLPFGTVVQTAWAAEALLQYVQPDDKVILKAISFLIQHQHSSEALHYPVGIGLPKQFYITYHSYPFVFPMMACSTFLEEMRRKNE

SEQ ID NO: 58 - protein, 638 aa, Bacillus sp.
MKNRNKGAGCMQLVKSEIERLKQQLLSEQTPDGSWNHPFDTGCMTDIYMIVLLRTLEEEDEEELIKELAKGILSRQGKDGAWRLFHDHHEGSLSLTIEAYYALLYSGYYEKNHPALVKARRVITKGGGLKKAGMYTKIMLALTGQYPWPLLFPVPMEVILLPRSFPLNMYDISVFGRSNLIPVILLGNKKFSRKTALSPDLGDLSVRDDDDPWPELRSAEWRSLTSFLAAGVKALVGIPRQIRAWSIEKAREYMQSHTEPDGTLYNYFSSTFYMIFALLALGGGPEEPAIRNAVAGLKRMTVKADGRTHIQYTTAAVWNTALISHALQEAGVPPKENAIQKANQYLAGQQHRRFGDWIVHNTKAEPGGWGFSRFNTINPDVDDTTAALRSLYQPAREKPHYDDIWKKGLLWTLSMQNRDGGWPAFERNVDKKLLHLLPIQGAEFILTDPSTADLTGRTLEFLGKAGYADASLPPIKKAVKWLKKHQEPNGSWYGRWGICYIYGTWAAVTGMAAVGVTLEDKSMKKGIDWLLSIQNEDGGWGESCRSDMEKKYIPLKESTLTQTAWAVDALAAAGMADSTPSRKGAAFLVREGKRKDWTADYPMGQGMANFFYIHYHSYRCIWPLLALSHYIEKSEAPD

SEQ ID NO: 59 - protein, 625 aa, Bacillus sp.
METLIDPEISRLTQRLLEDQEEDGAWRYCFENSLMTDAYMIVLIRSLGIKKERLVQELADRLLSQQEEKGFWKIYRDEVEGNLSATVEAYFALLWSGAVKEKDENMVKARDCILSGGGLDKVHSMTKFMLAAHGQYPWDRFFPVPVEVILLPTYFPVSFTDFSAYARVHLAPLLLLKSERYIRKTSTTPDLSYLLKDQEDFSFFREEERSFIEYVTSGVEAIAAFPANLNDLAKKTALNYMLARLEPDGSLYSYFSSSFYMIIALLSQGYSRKDPLVVNAIKALISYQCKGDGYPHIQNSPSTIWDTALISHALQSSGVDSRNAQILKASHYLYRHQHTQKGDWASEAPQTAPGGWGFSESNTINPDVDDTTAALRALKLDAYTDPVKRMAWNRGVKWALSMQNKDGGWPAFEKNKNKDILSWVPMDGAEDAALDRSCADLTGRTLEFLGNDAGMGRENSQVLKGIEWLMNNQENDGSWYGKWGICYIYGTWAALTGMMAAGMSADHQSIIKAIKWLYQIQNSDGGWGESCRSDKERKYISLGASTPSQTAWALDALISINDHPTKEIDRGIESLVRLLNTDDWRKEYPTGAGLPGRFYIHYHSYPYIWPLLALSNYKTKFLEVR

SEQ ID NO: 60 - protein, 632 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGVDRKHPGIQKALRWLKSIQNDDGSWGESCKSAEIKTYVPLHRGTIVQTAWALDALLTYENSEHPSVVKGMQYLTDSSSHSADSLAYPAGIGLPKQFYIRYHSYPYVFSLLAVGKYLDSIEKETANET

SEQ ID NO: 61 - protein, 556 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGLTESIPVYKRLCVGSNPYKMMTEAGENPAKAPKSKHMYRFIEEPLYKRPGL

SEQ ID NO: 62 - protein, 631 aa, Bacillus thuringiensis
MNIVIRISKGWVSNLLLDEKAHEEIVRRATALQTMQWQDGTWRFCFEGAPLTDCHTIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHVPTPIMFLQNDSPFSIFELSSSARIHLIPMMLCLNKRFRVGKKLLPNLNHIAGGGGEWFREDRSPVFQTLLSDVKQIISYPLSLHHKGYKEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAQALTPGGWGFSDVNTTIPDIDDTTAVLRALARSRGNKNIDNAWKKGVNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 63 - protein, 653 aa, Bacillus thuringiensis
MSNLLLYEKAHEEIARRATALQTMQREDGTWRFCFEGAPLTDCHMIFLLKLLGRDKEIEPFVKRLATLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKNIENKPRDISRFIFLGSRSLLKRIRLCFPYFSVDWRF

SEQ ID NO: 64 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEAGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSDVKKIITYPLSLHHKGYEEVERFMKERIDENGTLYSYATASFYMIYALLALGHSIQSPIIEKAITGITSYIWKMERGSHLQNSPSTIWDTALLSYALQEAQVPKASKVIHNASAYLLRKQQTKKVDWSVHAPDLFPGGWGFSDVNTTIPDIDDTTAALRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVMTGLRSFGIPSSNPSLKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYKK

SEQ ID NO: 65 - protein, 620 aa, Bacillus thuringiensis
MSNLLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKGRIDENGTLYSYATASFYMIYALLALGHSIQSPIIEKAIMGITSYIWKMERGSHLQNSPSTIWDTALLSYALQEAQVPKVSKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 66 - protein, 620 aa, Bacillus thuringiensis
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAENFIKERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLASDVKKIITYPLSLHHKGYEEVERFMKERIDENGTLYSYATASFYMIYALLALGHSIQSPIIEKAIMGITSYIWKMERGSHLQNSPSTIWDTALLSYALQEAQVPKASKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYGQNELPEKQKQSAINWLTNAQEENGSWYGKWGICYIYGTWAVLTGLRSLGIPSSDPSLKRAALWLEHIQHEDGGWGESCHSSVEKRFVTLPFSTPSQTAWALDALISYYDKETPVIRKGISYLLSNPYINEKYPTGTGLPGGFYICYHSYAHIYPLLTLAHYAKKYRK

SEQ ID NO: 67 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 68 - protein, 617 aa, Bacillus thuringiensis
MLLYEKVHEEIARRTTALQTMQRQDGTWRFCFEGAPLTDCHMIFLLKLLGKDKEIEPFVKRLASLQTNEGTWKLYEDEVGGNLSATIQSYAALLASEKYTKEDVNMKRAEMFINEHGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYALQEAQVPKASKVIHNASAYLLRKQQTKKVDWSVHAPDLFPGGWGFSDVNTTIPDIDDTTAALRALARSRGNENVDTAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 69 - protein, 617 aa, Bacillus thuringiensis
MLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAVHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEAVERFMKERIDENGTLYSYATASFYMIYALLALGHSIQSPIIQKAITGITSYIWKMERGSHLQNSPSTVWDTALLSYALQEAQVPKASKGIQNASAYLLRKQQTKKVDWSVHAPDLFPGGWGFSDVNTTIPDIDDTTAVLRALARSRGNENVDNSWKRAVNWVKGLQNNDGGWGAFEKGVTSRILANLPIENASDMIPDPSTPDITGRVLEFFGTYAQNELPEKQKQSAINWLMNIQEENGSWYGKWGICYIYGTWAVLTGLRSLGIPSSDPSLKRAALWLEHIQHEDGGWGESCQSSVEKRFVTLPFSTPSQTAWALDALISYYEKETPVIRKGISYLLSNPYVNEKYPTGTGLPGGFYIRYHSYTHIYPLLTLAHYAKKYRK

SEQ ID NO: 70 - protein, 617 aa, Bacillus weihenstephanensis
MLLYDKVHEEIERRTTALQTMQRQDGTWQFCFEGALLTDCHMIFLLKLLGRNDEIEPFVKRLVSLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLIQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 71 - protein, 698 aa, Bacterium Ellin514
MIKNFTALWPIRRVKGVSVTSQDGHSANGASKPDFEVRPHVDLETAIHRSQSFLLKEQKPEGYWVGELIVDSTLVSDTIAYHHWNGKVDMEWQRKAVNHIFSMQLPDGGWNIYYGGPAEINATVKAYLALKLAGVPVMDPRMLRARSVALSMGGVPRMNTFSKLYLALLGLFPWNYVPTIPCEVILIGKWFHVNFYEMSSWSRSMLVPLAIINHFKPTRKLQNQVKLDELYPEGYHERDLALPPDPEFLTFRNFFLWLDKLHKFAELWVQAGIHPFRRRALKKCEHWMLERFEGSNGLAAIFPAMLNSLIALKALGYPGDHPEVKRAEKELKNLEHETADTVRIEPCFSPVWDTAIVAICLHESGIPSDHPALKKSAEWLIDKEIRFRGDWYFKNPVDVEPSGWVFEFENKWNPDVDDTAMVLLALRKIPTSDVKRRDECFQRGLKWMMAFQCKDGGWAAFDKDCTKGILEKVPFADHNAMLDPECADITARILELLGYEGVGVDHPQIKKALQFIQEEQEDDGSWYGRWGVNYIYGTWQVLRGLRALNINMNQPWLLKARDWLESVQHEDGGWGERCNTYDDPVFKGQGPSTASQTAWAVMGLCTFDDPQRPSLMRGIDYLIKTQNSDGSWTEHEITGTGFPRVFYLKYDMYRNSWPLLALATYRNLYASSEKTANGHTNGHSVQLPEALKTPPAFK

SEQ ID NO: 72 - protein, 651 aa, Bacterium Ellin514
MKSEEVTIKPAVGLEKDELNAAITRSQSFLLCEQKPEGYWVGELMVDSTIVSDTIAYHHWNGKVDPEWQRKAVNHILSMQLPEGGWNIYQNGPPEVNATIKAYLALKLAGIPITDPRMLKARQVALTLGGVPRMNTFSKLYLALLGLWPWKYVPTIPCEVLLLGKWFHVNIWDMSNWSRAMIVPLAIINHYKPTRPVKVDLSELFLEGFHERDLALPKDPQSFTWRNFFLGLDQLHKFAELWVNAGIHPFRRLALKKCEQWMLERFEGSDGLAAIFPAMLNSLIALKSLGYPDDHPEVLRAERELKKLEHETKDTVRIEPCLSPGWDTAIAAMCLRESGVPAEHPRLKKAGDWLVNREVRFKADWHHKNPVDVEPSGWVFQFNNKWNPDLDDTAMVLLALRLIPTDHPRRRDEAFQRGLKWLLAFQCRDGGWAAYDKDCTKNILEKVPFADHNAMLDPECADITARVLELLGFEGYALDHPQVQEAVEYLREHQETDGSWYGRWGVNYIYGTWQTLRGLWALKMDMNQPWLLKARDWLESVQLPDGGWGERCNTYDDPVFKGQGPSTASQTAWAVMALCTFGDPKRPSLVRGIQYLIENQNEDGSWTELETTGTGFPRVYYLKYDIYRNTWPLLAMATYRKMLDPKEVRVK

SEQ ID NO: 73 - protein, 662 aa, Beijerinckia indica
MPEEAILTETHPLDATTIETAITRARKALLGEQRADGHFVFELEADVSIPCEYILFYHFIGRPAPAELEAKIGHYLRARQSAEHDGWPLFQDGAFNISSSVKAYFALKAIGDTPDMPHMQRARTAILAHGGAAAANVFTRSLLALFGLIPWHGIPVMPIEIMHLPEWFPFHIAKISYWGRTVLVPMMVVHALKPKPANTCTIRIDELFVIPPDQVRHWPGSPGKRFPWTAIFAGIDKVLQIAEPYFPRRSRQSAIDKAVAFVTKRLNGEDGLGAIYPAMAYSALMYLSIGRSLSDPHIQLVLKAIDKLVVVKDHEAYVQPCVSPVWDTALASHALMEAGDGDKPILDSLKKGLAWLKPLQVTDIAGDWAWKKPDVKPGGWAFQYGNAYYPDLDDTAVVVMAMDRARDRWPEIDEDNFRPSIARAREWIVGLQSENGGFGAFDADNDRDYLNAIPFADHGALLDPPTADVTARCISMLTQLGEKPENSETLRRAIAYLFAEQEKDGSWFGRWGLNYIYGTWSVLCSLNAAGIAHDAPEVRRAVAWLRTIQNEDGGWGEDAESYALDYAGYQQAPSTSSQTAWAVLGLMAAGEKDDPAVARGIAYLTRTQGEDGFWTEKRFTATGFPRVFYLRYHGYSKFFPLWAMARYRNLHNGNHASVLTGM

SEQ ID NO: 74 - protein, 691 aa, Blastopirellula marina
MEGASPTASNRISQYAVDLRAKARAAVASTCDWLLSHQHADGHWCAELEGDSILQSEYILLLAWLGKERTEIARRCAAHLLKQQEPNGAWTQFPGAPIDVGSSVKAYFALKLTGHDAAADYMVRARNAILEAGGADKVNSFTRFYLALLGQIPFELCPAVPPEMVLLPNWSPINIYRISSWSRTIFVPLSIVWAHRAARDIVEDVSIHELFIRKPEDWPELRCPGLEKPAGLFSWDRFFRTADSGLKLLEKYGLRPLRKRALRQAQQWMLDRFQQSDGPGAIFPPIVWSAIALRTLGYAEDSPEIQYCLDHLERLVLEDGETTKLQPCKSPVWDTSITLRALAAAGLGLAQEPTCRGVEWLLSKEVRVPGDWTNNVDCEPGGWFFEYENAFYPDNDDTSMGIMALADQLAAANITLEVHPGETLANTSVVVGGRGIAEQLAGSSAAMMEQAAAATRRAVAWMVAMQNKDGGWGAFDKNNDAEFLCHVPFADHNAMIDPSTPDLSARVIESFGRLGVTIESPGKLGDTVRRAVAYIRANQLSDGSWFGRWGVNYIYGTWQCLVGLRAVGVPANDPAIEQGKLWLLAHQQACGGWGESCETYEDPSLRGQGSPTASQTAWALLGIIAAGGANLAEVVHGVQYLMDTQREDGAWDEIEFTGTGFPRVFYLKYHYYPIYFPLLALAEWNRATARS

SEQ ID NO: 75 - protein, 610 aa, Blastopirellula marina
MDQDRLQRCYAIARDDLLAQRNGQGHWTGELSTSALSTATAVSALQLVVRHDPAQSERLMPLIEGGVRYLTEHQNPDGGWGDTDRSYSNIATTMLAVAALTIAERREALFEQLAFAENYIEAQGGIPGLRRRYGKDKTFAVPILTNYALAGLVDWREVSPLPFELACLPQKFYKLVKLPVVSYAIPALVAIGQARYFHRPPFNPLMRGLRGAAVKKSLAVLERMQPASGGYLEAAPLTSFVVMSLASIGNASHPVAQNGVQFLVDSVREDGSWPIDSNLANWVTTLSISALATGGDDIAELDCLPWVLANQYQETHPFTGADPGGWGWTDLSGSVPDADDTPGAMLAIAHFFHSPRADNETRRQIASAAISGARWLLDLQNSDGGWPTFCAGWGTQPFDRSGSDLTAHAIRALHAWRSELGDLPVERAIERGLRYLQKQQRDDGSWLPLWFGNQDIHDDENPIYGTVKVLLAYRDLGKMSSETAQRGAAWLAARQNEDGGFGGGPSISTLCGGPGESSVEETALAIEALFAAENSNISAEIVPPAVGWLCQRVEEGSYVNCTPIGFYFSKLWYYEKLYPRVMTVTSLGAALQANASVPPAPETVTTSSDH

SEQ ID NO: 76 - protein, 660 aa, Bradyrhizobium japonicum
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAGPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDTVSYRLDYKGWEAAPSTASQTAWALLALMAAGEVDHPAVARGVEYLIATQNEKGLWDEQRYTATGFPRVFYLRYHGYSKFFPLWGLARYRNLRNTNSRVVGVGM

SEQ ID NO: 77 - protein, 656 aa, Acetobacter pasteurianus
MAADGSALSESRLSSEALDRAVLSAHTALSQAQQDDGHWVYELEADATIPAEYILLEHFMDRIDDALEQKIAIYLRRIQSEEHGGWPLYHNGKFDLSATVKAYFALKAVGDDINAPHMQRAREAILDHGGAERSNVFTRSQLALFGEVPWRATPVMPVELMLLPAKAFFSVWNMSYWSRTVIAPLLVLAALRPVAANPRQVHVRELFVTPPEKVQDWIRGPYRSAWGYVFKGLDSVLRPVVPFIPEKTHKKAIQAALDFIEPRLNGKDGLGAIYPAMANVVMMYRAMGVPDEDPRAKTAWEAVQALIVEKDDEAYCQPCVSPIWDTGLSGHAMIEAASGPNGIAPEKTVAELKKASAWLRSKQILNVKGDWAVRNPNLAPGGWAFQYGNDYYPDVDDTAVVGMLLHREGDPTNAEAIERARTWIVGMQSTDGGWGAFDIDNNKDVLNHIPFADHGALLDPPTADVTARCISFLAQLRNPEDEPVIQRGLEYLRKEQEKDGSWFGRWGTNYIYGTWSALCALNAAGVSHDDPAVVKAVEWLRSVQRADGGWGEGCESYEGGPHGTYGESLPSQTAWAVLGLMAAGRRDDPAVTRGIAWLADQQDANGEWHEDPYNAVGFPKVFYLRYHGYKQFFPLMALARYRNLESSNTRRVSFGF

SEQ ID NO: 78 - protein, 684 aa, Bradyrhizobium sp.
MTLTSSASARAPRDPGNYQTALQSTVRAAADWLIANQKPDGHWVGRAESNACMEAQWCLALWFMGLEDHPLRKRLGQSLLDTQRPDGAWQVYFNAPNGDINATVEAYAALRSLGYPDSEPAVRRAREWIEAKGGLRNIRVFTRYWLALIGEWPWEKTPNIPPEVIWFPLWFPFSIYNFAQWARATLMPIALLSARRPSRPLPPENRLDTLFPRGRDAFDYELPVKANAGGWDKFFRGADKVLHALQNFGNRLNLGLFRPAATSRVLEWMIRHQDFDGAWGGIQPPWIYGLMALYAEGYPLNHPVLAKGLDALNDPGWRVDVGEATYIQATNSPVWDTILTLLAFDDAGVLGDYPDAVDKAVNWVLARQVRVPGDWSMKLPHVKPGGWAFEYANNHYPDTDDTAVALIALAPLRHDPKWKAKGIDEAIQLGVDWLIGMQSQGGGWGAFDKDNNQQILTKIPFCDYGEALDPPSVDVTAHIVEAFGKLGISRNHPSMVQALDYIRKEQEPSGPWFGRWGVNYVYGTGAVLPALAAIGEDMTQPYIGRACDWLVAHQQPDGGWGESCASYMDISAVGRGTTTASQTAWALMALLAANRPQDKDAIERGCMWLVERQSAGTWDEPEFTGTGFPGYGVGQTIKLTDPSLQERLMQGPELSRAFMLRYGMYRHYFPLMALGRALRPQGHG

SEQ ID NO: 79 - protein, 660 aa, Brevibacillus brevis
MRIGTTTNPSMPFPLSSSGAVFYREVNELREVQQEINRIQAFLLQRQQEDGTWRFCLESSPMTDSHMIILLRTLGIHDERLMEKLTAHITALQHDNGAWKLYPDEQEGHLSTTIDSYYALLLSGKYTKNEPRMALARSFILEKGGLTQANMLTKFATALTGQYQWPSHFLVPVEIALLPPSFPVSFYDFVGYARVHLAPMMIVADRNYVKKPDNAPDLSDLYADTPISRGLYPHRFLENFLKEGQSFLATIHDSLQQLPFLPGQLHKLALRRLEQYILARIEPDGTLYNYSTSTFFMIFALLARGFSPKDPLIQKAMQGLTGSVYDYENGAHLQLATSAVWDTALLTFSLQKSGLSPTHPAIQKANRYLLRKQQHTYGDWKIRNPNGKPGGWGFSDYNTMNPDIDDTTAALRSLRLLARTDVTAATAWKRGLEWLLSMQNDDGGWPAFERNTDADFIRHLPIEGADTVSTDPSSADLTGRTLEFLGNYAGRTLTDLHVEKGVRWLLKHQESDGSWYGRWGIAYLYGTWAAITGLMAVGFSPTEPAIQKAVAWLVANQNPDGGWGESCQSDLKKTYVPLGASTPSQTAWAIDALIAVSSKPTAELQRGIRYLLTHNQANDWTTRYPTGGGRPGGTYFAYHSYRWIWPLLALSHYQVKYANT

SEQ ID NO: 80 - protein, 682 aa, Burkholderia ambifaria
MIRRMNKPAPSPWSALDTAIARGRDALMRLQQPDGSWCFELESDATITAEYILMMHFMDKIDDARQEKMARYLRAIQRLDTHGGWDLYLDGDPDLSCSVKAYFALKAAGDSEHAPHMVRARDAILKLGGAARSNVFTRILLATFGQVPWRATPFMPIEFVLFPKWVPISMYKVAYWARTTMVPLLVLCSLKARARNPRNIAIPELFVTPPDQERQYFPPARGMRRAFLALDRVVRHVEPLLPKRLRQRAIRHAQAWCAERMNGEDGLGGIFPPIVYSYQMMDVLGYPDDHPLRRDCENALEKLLVTRPDGSMYCQPCLSPVWDTAWSTMALEQARGVAVPEAGAPAGALDELDARIARAYDWLAERQVNDLRGDWIENAPADTQPGGWAFQYANPYYPDIDDSAVITAMLDRRGRTHRNADGSHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFPRIFYLKYHGYTAYFPLWALARYRRLAGGASSAGAHTVPASTGADAALA

SEQ ID NO: 81 - protein, 682 aa, Burkholderia ambifaria
MIRRMNKPAPSPWSALDAAIARGRDALMRLQQPDGSWCFELESDATITAEYILMMHFMDKIDDARQEKMARYLRAIQRLDTHGGWDLYVDGDPDVSCSVKAYFALKAAGDSEHAPHMVRARDAILALGGAARSNVFTRILLATFGQVPWRAAPFMPIEFVLFPKWVPISMYKVAYWTRTTMVPLLVLCSLKAHARNPRNIAIPELFVTPPDQERHYFPPARGMRRAFLALDRVVRHAEPLLPKRLRQRAIRHAQAWCAERMNGEDGLGGIFPPIVYSYQMMDVLGYPADHPLRRDCENALEKLLVTRPDGSMYCQPCLSPVWDTAWSTMALEQARGVAVHEAGAPASALDELDARIARAYDWLAERQVNDLRGDWIENAPADTQPGGWAFQYANPYYPDIDDSAVVTAMLDRRGRTHRNADGTHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFTRIFYLKYHGYTAYFPLWALARYRRLAGGASSAGAHAVPASTAADAALA

SEQ ID NO: 82 - protein, 678 aa, Burkholderia ambifaria
MNKPAPSPWSALDTAIARGRDALMRLQQPDGSWCFELESDATITAEYILMMHFMDKIDDVRQEKMARYLRAIQRLDTHGGWDLYVDGDPDVSCSVKAYFALKAAGDSEHAPHMVRARDAILALGGAARSNVFTRILLATFGQVPWRATPFMPIEFVLFPKWVPISMYKVAYWARTTMVPLLVLCSLKARARNPRNIAIPELFVTPPDEERHYFPPARGMRRAFLALDRVVRHVEPLLPKRLRQRAIRHAQAWCAERMNGEDGLGGIFPPIVYSYQMMDVLGYPDDHPRRRDCENALEKLLVTRTDGSMYCQPCLSPVWDTAWSTMALEQARAVAVPEAGARASALDELDARIARAYDWLAERQVNDLRGDWIENAPADTQPGGWAFQYANPYYPDIDDTAVVTAMLDRRGRTHRNADGSHPYAARVARALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDPSQPYIARALAWLRARQHADGGWGETNDSYIDPTLAGTNAGESTSNCTAWALLAQMAFGDCESESVRRGIAYLQSVQQDDGFWWHRSHNAPGFPRIFYLKYHGYTAYFPLWALARYRRLASGVSSAGVHAVPASTGADAALA

SEQ ID NO: 83 - protein, 657 aa, Burkholderia ambifaria
MNDLTEMATLSAGTVPAGLDAAVASATDALLAAQNADGHWVYELEADSTIPAEYVLLVHYLGETPNLELEQKIGRYLRRVQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFVDPPVNAGLLPRQGHQSPGWFAFFRVVDHVLRAADGLFPSYTRERAIRQAVSFVDERLNGEDGLGAIYPAMANAVMMYDVLGYAEDHPNRAIARKSIEKLLVVHEDEAYCQPCLSPVWDTSLAAHALLETGDARAEEAVIRGLEWLRPLQILDVRGDWISRRPHVRPGGWAFQYANAHYPDVDDTAVVAVAMDRVQKLKHNDTFRDSIALAREWVVGMQSSDGGWGAFEPENTQYYLNNIPFSDHGALLDPPTADVSGRCLSMLAQLGETPLNSEPARRALDYMLKEQEPDGSWYGRWGMNYVYGTWTALCALNAAGLTPDDPRVKRGAQWLLSIQNKDGGWGEDGDSYKLNYRGFEQAPSTASQTAWALLGLMAAGEVNNPAVARGVEYLIAEQKEHGLWDETRFTATGFPRVFYLRYHGYRKFFPLWALARYRNLKRDNATHVTFGL

SEQ ID NO: 84 - protein, 687 aa, Burkholderia cenocepacia
MIRRMNQSAPSSWSALDAAIARGRDALVRLQQPDGSWCFELESDATITAEYILMMHFMDRIDDVRQEKMARYLRANQRLDTHGAWDLYVDGAPDVSCSVKAYFALKAAGDSEHAPHMIRARDAILKLGGAARSNVFTRILLATFGQVPWRAAPFMAVEFVLFPKWVPISMYKVAYWARTTMVPLLVLCSLKARARNPRNVSIRELFVTPPEQERHYFPPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTATGAPRDLDGRIARAYDWLATRQVNDLRGDWIENAPADVEPGGWAFQYANPYYPDIDDTALVTAMLDRRGRTHRAADGTHPYASCVSRALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDKSQPYIARALDWLRARQHADGGWGETNDSYLDPKLAGTNGGESTSNCTAWALLAQMAFGDCESDSVKRGIAYLQSVQQEDGFWWHRSHNAPGFPRIFYLKYHGYTAYFPLWALARYRRLAGAKDAGATRSGASGASATSVTDDALA

SEQ ID NO: 85 - protein, 684 aa, Burkholderia cenocepacia
MIRRMNKSAPSPWSALDAAIARGRDALVRLQQPDGSWCFELESDATITAEYILMMHFMDRIDDVRQERMARYLRANQRLDTHGAWDLYVDGAPDVSCSVKAYFALKAAGDSEHAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERHYFLPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTASGALRELDERIARAYDWLATRQVNDLRGDWIENAPADVEPGGWAFQYANPYYPDIDDTALVTAMLDRRGRTHRGADGTHPYASRVARALDWMRGLQSRNGGFAAFDADCDRMYLNAIPFADHGALLDPPTEDVSGRVLLCFGVTKRAADRASLAHAIDYVKRTQQPDGSWWGRWGTNYLYGTWSVLAGLALAGEDKSQPYITRALDWLRARQHADGGWGETNDSYIDPKLAGTNDGESTSNCTAWALLAQMAFGDCESDSVKRGIAYLQSVQQEDGFWWHRSHNAPGFPRIFYLKYHGYTAYFPLWALARYRRLAGAKDADATRSPASATPATDNALA

SEQ ID NO: 86 - protein, 679 aa, Burkholderia cenocepacia
MIRRMNKSAPSPWSTLDTAIARGRDALVRLQQPDGSWCFELESDATITAEYILMMHFMDRIDDVRQEKMARYLRANQRLDTHGAWDLYVDGAPDVSCSVKAYFALKAAGDSEQAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERRYFPPARGMRRLFLALDRAVRHIEPLMPKRLRQRAIRHAQAWCAERMNGEDGLGGIFPPIVYSYQMMQVLGYPDDHPLRRDCENALEKLLVTRPDGSVYCQPCLSPVWDTAWSTMALEQARGVAAPETGETAAGTLRELDERIARAYDWLAARQVNDLRGDWIENVPADVEPGGWAFQYANPYYPDIDDSALVTAMLDRRGRTHRHADGTNPYAPRVARALDWMRGLQSRNGGFAAFDADCDRMYLNAIPFADHGALLDPPTEDVSGRVLLCFGVTKRAEDRASLARCIDYVKRTQQPDGSWWGRWGTNYLYGTWSVLAGLALAGEDKSQPYIARALDWLRARQHADGGWGETNDSYLDPTLAGTNGGESTSNCTAWALLAQMAFGDCESDSVKRGIAYLQSVQQEDGFWWHRSHNAPGFPRIFYLKYHGYTAYFPLWALARYRRLAGAAAAPPAALVAADTALA

SEQ ID NO: 87 - protein, 657 aa, Burkholderia cenocepacia
MNDLTEMATLSAGAVPAGVDAAVARATDALLAAQQADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSPGWFAFFRVVDHALRAVDGLFPSYTRERAIRQAVSFVDERLNGEDGLGAIYPAMANSVMMYAALGYAEDHPNRAIARKSVEKLLVVHDDEAYCQPCLSPVWDTSLAAHALLETGDARAQEAVLRGLEWLRPLQILDVRGDWISRRPNVRPGGWAFQYANAHYPDVDDTAVVVMAMDRAQKLTQSDTYRESMARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRMKRGAQWLLSIQNKDGGWGEDGDSYKLNYRGYEQAPSTASQTAWALLGLMAAGEVNNPAVARGVDYLVAQQNEEGLWDETRFTATGFPRVFYLRYHGYRKFFPLWALARYRNLKRANATRVTVGM

SEQ ID NO: 88 - protein, 658 aa, Burkholderia dolosa
MNDLTDMATLSAGAAPAADLDAAVARATDALLAAQNADGHWVYELEADSTIPAEYVLLVHYLGETPNLELERKIGRYLRRIQQADGGWPLFTDGAPNVSASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHVLRAVDGLFPKYTRERAIRQAVSFVDERLNGEDGLGAIYPAMANAVMMYDVLGYAEDHPNRAIARKSIEKLLVVHDDEAYCQPCLSPVWDTSLAAHALLETGDPRAEDAALRGLEWLRPLQILDVRGDWISRRPNVRPGGWAFQYANAHYPDVDDTAVVAMAMDRAQKLRQSDTYRESIARAREWVVGMQSSDGGWGAFEPENTQYYLNNIPFSDHGALLDPPTADVSGRCLSMLSQLGESALTSEPARRALDYMLKEQEPDGSWYGRWGMNYVYGTWTALCALNAAGLGPDDPRVKRAAQWLLSIQNKDGGWGEDGDSYKLNYRGYEQAPSTASQTAWALLGLMAAGEVNNPAVARGIDYLLAEQKEHGLWDEVRFTATGFPRVFYLRYHGYRKFFPLWALARYRNLKRANATRVTVGM

SEQ ID NO: 89 - protein, 776 aa, Burkholderia glumae
MNDLTNSSAPGARPDDATPSAAGPTPAEAAGGAVAPSRAVQPADTQTAATGAAGAAAAVGATPAELAATAPASSGTPAGASAAPAPSGTPSVDAPAELASAAPAPSGATPAATATAATAPAPARAASIDAPALAAADLDAAITRATDALLAAQQADGHWIYELEADSTIPAEYVLLVHYLGETPNLELERKIARYLRRVQLPGGGWPLFTDGAPDVSASVKAYFALKMIGDDANAEHMVRARNAIHAMGGAEMSNVFTRIQLALFGVVPWFAVPMMPVEIMLLPQWFPFHLSKVSYWARTVTVPLLVLSAKRPLARNPRGVRVDELFVAPPVNAGLLPRAGHQSPAWFACFRLLDGLLRLTDGLFPRYTRERAIRQALQFVDERLNGEDGLGAIYPAMANSVMMYAALGYPEDHPNRATARRAIEKLLVIHDDEAYCQPCLSPVWDTSLAAHALLETGEPRAEAAAIRGLDWLRPLQILDVRGDWISRRPDVRPGGWAFQYANPHYPDVDDTAVVTLAMDRVAKLAQTDAYRDAIARAREWVVGMQSSDGGWGAFEPENTHQYLNSIPFSDHGALLDPPTADVSGRCLSMLAQLGETAANSAPARRALDYLLAEQGADGSWYGRWGMNYIYGTWSALGALNAAGLPFDDPRVKRAAQWLLSIQNPDGGWGEDGDSYKLDYRGYERAASTASQTAWALLGLMAAGEVEHPAVARGIAWLAAQQREHGLWDEARFTATGFPRVFYLRYHGYRKFFPLWALARYRNLRRTGTRRVTVGM

SEQ ID NO: 90 - protein, 676 aa, Burkholderia glumae
MIRPMKNSDLPLPSLLDAAILRGRDALAQRQSADGSWCFELESDATITAEYILMMHFMGKIDEARQARMARYLRGIQRLATHGAWDLYVDGAPDVSCSVKAYFALKAAGDSEDAPHMARARETILKLGGAAKSNVFTRILLATFGQVPWRATPFMPVEFVLFPKWVPISMYKVAYWARTTMVPLLVLCSLKARAKNPRNVSIRELFVTAPEAERHYFARGGFVRNLFLGIDRALRPLDALIPKALRRRAIRHAEAWCAERMNGEDGMGGIFPPIVYSYQMMDVLGYPEDHPLRRDCENALDKLLVERPDGSVYCQPCLSPVWDTAWSTMALEQARAVPDPRDAPPVSDAQLQRCIAASYEWLAGKQVTQVRGDWVENAPAATPAGGWAFQYENPYYPDIDDSAVVAAMLHRRGRLLARSTGTDPYAQVVARGLDWMRGLQSRNGGFGAFDADCDRLYLNLIPFADHGALLDPPTEDVSGRVLLCLGVTGRDEDKPALARAIEYVKRMQRADGCWWGRWGTNYIYGTWSVLAGLALAGENPSQPYIARAIAWLRACQNADGGWGETNDSYLDPALAGTNGGESASNVTAWALLAQMAFGDWQSESVQRGIRYLLSVQQADGFWWHRSHNAPGFPRIYYLKYHGYTAYFPLWALARYRRLSQAGAARDVTDGAALAAS

SEQ ID NO: 91 - protein, 683 aa, Burkholderia graminis
MNDLSQAHVLGAAMPETAGEAQNAQAAANSAAAAAEASAVLAPSLDAAITRATDAILAAQKPDGHWVYELEADATIPAEYVLLVHYLGETPNVELEQKIARYLRRIQLPNGGWPLFTDGAIDISASVKAYFALKMIGDPVDAEHMVRAREAILAHGGAETVNVFTRILLALFGVVSWRAVPMMPVEITLLPMWFPFHLSKVSYWARTVIVPLLVLNAKRPLARNPRRVRIDELFRGAPVNTGMPARAPHQHVGWFGFFRVVDTVLRAVDGLFPKATRERAVREAVAFVDQRLNGEDGLGAIFPAMANSVMMYDVLGYPADHPNRAIARRSIEKLLVIKDDEAYCQPCLSPVWDTSLAAHALLETGDARAEQAAERGLAWLRPLQILDVRGDWISRRPNVRPGGWAFQYNNAYYPDVDDTAVVAMAMHRSEALTHSGADREAIARAREWVVGMQSSDGGWGAFEPENTQYYLNNIPFSDHGALLDPPTADVSGRCLSMLAQLGEFPQNSEPAQRALDYMLKEQEADGSWYGRWGLNYIYGTWTALCSLNAAGLPHDDPRIRRAAQWLLSIQNEDGGWGEGGESYKLDYRGYERAPSTASQTAWALMGLMAAGEVDHEAVARGIEYLQREQREHGLWDETRFTATGFPRVFYLRYHGYRKFFPLWALARYRHLKRNGLTRVAVGM

SEQ ID NO: 92 - protein, 657 aa, Burkholderia mallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGEVDNPAVARGVDYLLGTQREHGLWDETRFTATGFPRVFYLRYHGYRKFFPLWALARYRNLKRANAMRVTVGM

SEQ ID NO: 93 - protein, 683 aa, Burkholderia multivorans
MIRAMNKSALSPWSALDTAIARGRDALARLQQPDGSWCFELESDATITAEYILMMHFMDRIDDALQERMARYLRAIQRLDTHGAWDLYVDGAPDVSCSVKAYFALKAAGDSEHAPHMIRAREAILKLGGAARSNVFTRILLATFGQVPWRATPFMPIEFVLFPKWVPISMYKVAYWARTTMVPLLVLCSLKARARNPRNVAIPELFVTPPDQERHYFPPTRGMRRAFLILDRVVRHVEPLLPKRLRRRAIRHAEAWCAQRMNGEDGLGGIFPPIVYSYQMMDVLGYPEDHPLRRDCENALAKLLVTRPDGSVYCQPCLSPVWDTAWSTMALEQARSVAVPESDESARALDELDARIARAYDWLATRQVNDLRGDWIENAPADTQPGGWAFQYANPYYPDIDDSAVVTAMLDRRGRTHRNADGSHPYAARVARALDWMRALQSRNGGFAAFDADCDRLYLNAIPFADHGALLDPPTEDVSGRVLLCFGVTRRAEDRASLARAIDYVKRTQQPDGSWWGRWGTNYLYGTWSVLAGLTLAGEDPSQPYIARALEWLRAHQHADGGWGETNDSYLDPALAGTNGGESTSNCTAWALLAQMAFGDCASDSVKRGIAYLQSVQQDDGFWWHRSHNAPGFPRIFYLKYHGYTAYFPLWALARYRRLAGAAEARARASSGRAPHAADTALA

SEQ ID NO: 94 - protein, 657 aa, Burkholderia multivorans
MNDLTDMATLSAGTVPAELDAAVARATDALLAAQNADGHWVYELEADSTIPAEYVLLVHYLGETPNLELEQKIGRYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRAVDHVLRAVDGLFPAYTRERAIRQAVAFVDERLNGEDGLGAIYPAMANAVMMYDVLGYAEDHPNRAIARKSIEKLLVVHEDEAYCQPCLSPVWDTSLAAHALLETRDPRAEQAAVRGLDWLRPLQILDVRGDWISRRPHVRPGGWAFQYANPHYPDVDDTAVVAMAMDRAQKLNQSDTYRESIARAREWVVGMQSSDGGWGAFEPENTQYYLNNIPFSDHGALLDPPTADVSGRCLSMLSQLGETALNSDAARRALDYMLKEQEPDGSWYGRWGMNYVYGTWTALCALNAAGLGPDDARVKRAAQWLLSIQNKDGGWGEDGDSYKLNYRGYEPAPSTASQTAWALLGLMAAGEVNNPAVKRGIDYLIAEQKEHGLWDEARFTATGFPRVFYLRYHGYRKFFPLWALARYRNLKRDNTTRVTVGI

SEQ ID NO: 95 - protein, 668 aa, Burkholderia oklahomensis
MNDMTEMHTLDAAAAPAADAPAVTAVTAGLDAAVARATDALLAAQNADGHWVYELEADSTIPAEYVLLVHYLGEEPNAELEQKIARYLRRIQQPDGGWPLFTDGAPNVSASVKAYFALKVIGDDENAEHMQRARRAIHAMGGAETSNVFTRIQLALYGVVPWYAVPMMPVEVMLLPQWFPFHLSKVSYWARTVIVPLLVLNAKRPVAKNPRGVRIDELFKSAPVNTGLLPKQPHQSTGWFAFFRAVDGVLRLVDGLFPRYTRERAIRQAVAFVDERLNGEDGLGAIYPAMANAVMMYAALGYPEDHPNRAIARQSIEKLLVVGEEEAYCQPCLSPVWDTSLAAHALLETGDERARDAAVRGLDWLIPRQILDVRGDWISRRPHVRPGGWAFQYANPHYPDVDDTAVVVMAMDRVAKLDQSDAYREQIARAREWVVGMQSSDGGWGAFEPENTQYYLNNIPFSDHGALLDPPTADVSGRCLSMLAQLGETNASSEPARRAFDYMLKEQEPDGSWYGRWGMNYIYGTWTALCALNAAGLGHDDPRVKRAAQWLLSIQNQDGGWGEDGESYKLDYRGYERAPSSSSQTAWALLGLMAAGEVDNPVVARGIDYLLGAQCEHGLWDETRFTATGFPRVFYLRYHGYRKFFPLWALARYRNLKRANTTRVTVGM

SEQ ID NO: 96 - protein, 677 aa, Burkholderia phymatum
MNDLSMTQTLGEVLPQTLIDDHAPVAAALATGAAPVDALDAAVTRATEAILAVQKDDGHWVYELEADATIPAEYVLLVHFLGETPNLELEQKIARYLRRIQLPNGGWPLFTDGAMDVSASVKAYFALKMIGDPEDAAHMVRARECILANGGAEAANVFTRILLALFGVVTWYAVPMMPVEIMLLPKWFPFHLSKVSYWARTVIVPLLVLNAKRPVARNPRGVRIDELFRGAPVTTGLLPRSGHQSKSWFAFFRAVDGVLRVTDGLFPKASRERAIKAAVSFVDERLNGVDGLGAIFPAMANSVMMYDVLGYPADHPNRAIARESIEKLLVVHEDEAYCQPCLSPVWDTSLAAHALLETGDARAEEAAERGLAWLRPLQILDVRGDWISRRPDVRPGGWAFQYNNAHYPDVDDTAVVAMAMHRSAAVTNSNVDANAIARAREWVVGMQSSDGGWGAFEPENTQYYLNNIPFSDHGALLDPPTADVSGRCLSMLAQLGEMPATSEPARRAYDYLLKEQEDDGSWYGRWGMNYIYGTWTALCALNAAGISLEDARIKRAAQWLVSIQNADGGWGEDGTSYKLDYRGYEKAPSIPSQTAWALLGLMAAGYVDHPAVARGIDYLQREQRDHGLWDEERFSATGFPRVFYLRYHGYRKYFPLWALARYRNLKRTGEKRVTVGM

SEQ ID NO: 97 - protein, 676 aa, Burkholderia phytofirmans
MNDLSQAQPLDAILPDFADAAPSAPAPAVTGEAPTASLDAAITRATEAILAAQKPDGHWVYELEADATIPAEYVLLVHYLGETPNLELEQKIARYLRRIQLPDGGWPLFTDGALDISASVKAYFALKMIGDPADAEHMVRAREAILAHGGAETVNVFTRILLALFGVVSWRAVPMMPVEIMLLPMWFPFHLSKVSYWARTVIVPLLVLNAKRPVARNPRRVRIDELFRGAPVNTGPRDRAPHQHAGWFRFFSGVDVLLRAVDGLFPKSTRERAVRQAVAFVDERLNGEDGLGAIFPAMANSVMMYDVLGYPADHPNRAIARQSIDKLLVIKDDEAYCQPCLSPVWDTSLAAHALLETGEAHAEQAAERGLAWLRPLQILDVRGDWISRRPNVRPGGWAFQYNNAHYPDVDDTAVVAMAMQRSATVTQSDVDRDAIARAREWVVGMQSSDGGWGAFEPENTQYYLNNIPFSDHGALLDPPTADVSGRCLSMLAQLGELPQNSEPAQRAFDYMLKEQESDGSWYGRWGLNYIYGTWTALCSLNAAGLPHDDPRMKRAAQWLLSIQNEDGGWGEGGESYKLDYHGYERAPSTASQTAWALMGLMAAGEVNHEAVARGVAYLEREQREHGLWDETRFTATGFPRVFYLRYHGYRKFFPLWALARFRHLKRNGLTRVAVGM

SEQ ID NO: 98 - protein, 657 aa, Burkholderia pseudomallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGAVDNPAVARGVDYLLGTQREHSLWDETRFTATGFPRVFYLRYHGYRKFFPLWALARYRNLKRANATRVTVGM

SEQ ID NO: 99 - protein, 681 aa, Burkholderia sp.
MNDLSQTQPLAAVLPEAADAPAVADASATAAPEPVQAASPSALDASITRATDTILAAQKPDGHWVYELEADATIPAEYVLLVHYLGETPNLELEQKIARYLRRIQLPNGGWPLFTDGALDISASVKAYFALKMIGDPVDAEHMVRARDAILAHGGAERANVFTRILLALFGVVSWRAVPMMPVEIMLLPVWFPFHLSKVSYWARTVIVPLLVLNAKRPLARNPRKVRIDELFRAAPVNTGMNERAPHQHAGWFGFFRCVDTVLRAVDGLLPKATRERAIRAAVAFVDERLNGEDGLGAIFPAMANSVMMYDVLGYPADHPHRAIARKSLDKLLVIKDDEAYCQPCLSPVWDTSLAAHALLETGEARAEQAAERGLAWLRPLQILDVRGDWISRRPNVRPGGWAFQYNNAHYPDVDDTAVVAMAMHRSAALTQSDVDREAIARAREWVVGMQSSDGGWGAFEPENTQYYLNNIPFSDHGALLDPPTADVSGRCLSMFAQIGELPQSSEPARRAFDYMLQEQEPDGSWYGRWGLNYIYGTWTALSSLNAAGMPHDDPRMRRAAQWLVSIQNEDGGWGEGGESYKLDYHGYERAPSTASQTAWALLGLMAAGEVNHEAVARGIDYLQREQREHGLWDETRFSATGFPRVFYLRYHGYRKFFPLWALARFRHLKRHGLTRVTVGM

SEQ ID NO: 100 - protein, 678 aa, Burkholderia sp.
MIRRMTTPTPSPWSALDTAIARGRDALVRLQQPDGSWCFELESDATITAEYILMMHFMDKIDDLRQEKMARYLRANQRLDTHGGWALYVDGDPDVSCSVKAYFALKAAGDSEHAPHMVRARDAILKLGGAARANVFTRILLATFGQVPWRAAPFMPIEFVLFPKWVPISMYKVAYWARTTMVPLLVLCSLKARARNPRNISIRELFVTPPDEERQYFPPARGMRKLFLALDRTVRHVEPLMPKGLRQRAIRHAEAWCAERMNGEDGLGGIFPPIVYCYQMMEVLGYPDDHPLRRDCENALEKLLVTRPDGSMYCQPCLSPVWDTAWSTMALEQARGVAVAEDGEPGDARRALDERITRAYDWLAERQVNDLRGDWIENAPADVQPGGWAFQYANPYYPDIDDTAVVTAMLDRRGRTHANADGTNPYATRVARALDWMRGLQSRNGGFGAFDADCDRLYLNAIPFADHGALLDPPTEDVSGRVLLCFGVTKRADEHASLARCIDYVKRTQQPDGSWWGRWGTNYIYGTWSVLAGLALAGEDKSQPYIARAIEWLRARQHADGGWGETNDSYIDPKLGGTNGGESTSNFTAWALLAQMAFGDCESDSVKRGIAYLQSVQQEDGFWWHRSHNAPGFPRIFYLKYHGYTAYFPLWALARYRRLAGVANKRVSTADKTADAMA

SEQ ID NO: 101 - protein, 657 aa, Burkholderia sp.
MNDLTEMATLSAGAVPAGVDTAVARATDALLAAQNADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHALRAVDGLFPNYTRERAIRQAVSFVDERLNGEDGLGAIYPAMANSVMMYDVLGYAEDHPNRAIARKSIEKLLVVQEDEAYCQPCLSPVWDTSLAANALLETRDARAEDAAIRGLEWLRPLQILDVRGDWISRRPHVRPGGWAFQYANAHYPDVDDTAVVAVAMERAQQLKQNDAYRDSIARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRVKRGAQWLLSIQNKDGGWGEDGDSYKLNYRGFEQAPSTASQTAWALLGLMAAGEVNNPAVARGIDYLIAEQNAEGLWDETRFTATGFPRVFYLRYHGYRKFFPLWALARYRNLKRDNTTRVTVGL

SEQ ID NO: 102 - protein, 694 aa, Burkholderia sp. CCGE1002
MNDLSQTQPLDAVLPEAADAASNLAEAAVVANAPAVADALATATPSPMQTAGASPLDVSITRATDAILAAQQPDGHWIYELEADATIPAEYVLLVHYLGETPNLELEQKIARYLRRIQLPNGGWPLFTDGALDISASVKAYFALKMIGDPVDAEHMVRARDAILAHGGAEHANVFTRILLALFGVVSWRAVPMMPVEIMLLPMWFPFHLSKVSYWARTVIVPLLVLNAKRPLARNPRKVRIDELFRGAPVNTGMNERAPHQHAGWFGFFRCVDTVLRAVDGLLPKASRERAIRAAVAFVDERLNGEDGLGAIFPAMANSVMMYDVLGYPADHPNRAIARKSLDKLLVIKEDEAYCQPCLSPVWDTSLVAHALLETREARAEQAAERGLAWLRPLQILDVRGDWISRRPNVRPGGWAFQYNNAHYPDVDDTAVVAMAMHRSAALTKSDVDREAIARAREWVVGMQSSEGGWGAFEPENTQYYLNNIPFSDHAALLDPPTADVSGRCLSMFAQIGELPQNSEPAQRAFDYMLQEQESDGSWYGRWGLNYIYGTWTALCSLNAAGMSHDDPRMRRAVQWLVSIQNEDGGWGEGGESYKLDYRGYERAPSTASQTAWALLGLMAAGEVDHDAVARGIDYLQREQREHGLWDETRFTATGFPRVFYLRYHGYRKFFPLWALARFRHLKRNGLTRVTVGM

SEQ ID NO: 103 - protein, 672 aa, Burkholderia thailandensis
MNDMTEMHTLDATAVPAAPAAADAPAPSAATTGLDAAVARATDALLAAQNADGHWVYELEADSTIPAEYVLLVHYLGEEPNAELEQKIARYLRRIQQPDGGWPLFTDGAPNISASVKAYFALKVIGDDENAEHMQRARRAIHAMGGAEMSNVFTRIQLALYGVVPWYAVPMMPVEIILLPQWFPFHLSKVSYWARTVIVPLLVLNAKRPVAKNPRGVRIDELFKSAPVNTGLLPKQPHQHAGWFAFFRAVDGVLRLADGLFPRYTRERAIRQAAAFVDERLNGEDGLGAIYPAMANAVMMYAALGYPEDHPNRAIARQSIEKLLVVGEEEAYCQPCLSPVWDTSLAAHALLETGDERAREAAVRGLDWLVPRQILDVRGDWISRRPHVRPGGWAFQYANAHYPDVDDTAVVVMAMDRVAKHDQTDAYRESIARAREWVVGMQSSDGGWGAFEPENTQYYLNNIPFSDHGALLDPPTADVSGRCLSMLAQLGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDNPAVARGIGHLLGTQREHGLWDETRFTATGFPRVFYLRYHGYRKFFPLWALARYRNLKRAGAARVTVGM

SEQ ID NO: 104 - protein, 663 aa, Burkholderia thailandensis
MNDMTEMHTLDATAAPAAPTVATGLDAAVARATDALLAAQNADGHWVYELEADSTIPAEYVLLVHYLGEAPNVELERKIARYLRRIQLPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKSAPVNTGLLPKQPHQSAGWFAFFRAVDGVLRLTDGLFPRYTRERAIRQAVAFVDERLNGEDGLGAIYPAMANAVMMYAALGYPEDHPNRAIARQSIEKLLVVGEDEAYCQPCLSPVWDTSLAAHALLETGDERAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDHPAVARGIDHLLGTQREHGLWDETRFTATGFPRVFYLRYHGYRKFFPLWALARYRNLKRANATRVTVGM

SEQ ID NO: 105 - protein, 678 aa, Burkholderia ubonensis
MKPNHTFSPAALDAAILRGRDTLSGLQQPDGSWCFELESDATITAEYILMMHFMDKIDEVRQAQMARYLRAIQRVETHGAWDLYVDGAPDISCSVKAYFALKAAGDSEHAPHMIRAREAILKLGGAARSNVFTRILLATFGQVPWRAAPFMPVEFVLFPKWVPISMYKVAYWARTTMVPLLVLCSLRARARNPRNVSIAELFVTPPDEERHYFPPAKGMRKLFLALDRTVRHLEPLLPRRLRQRAIRHAEAWCAERMNGEDGLGGIFPPIVYSYQMMEVLGYPEDHPLRRDCEDALEKLLVTRADGSVYCQPCLSPVWDTAWSTMALEQARGATPAAPDTQVSERELDARIARAYDWLATRQVNDLEGDWRENARPGTLPGGWAFQYANPYYPDIDDSAVVTAMLDRRGRAQARASGENPYAERVTRALDWMRGLQSRNGGFGAFDADCDRLYLNAIPFADHGALLDPPTEDVSGRVLLCFGVTKRPADRAAAARAIEYVKRTQQPDGSWWGRWGTNYLYGTWSVLAGLALSGEDKSQPYIARALDWLRAHQHADGGWGETNDSYADPRLRATNYGESTSNCTAWALLAQMAFGDWQSDSVRRGIAYLLSVQQDDGFWWHRSHNAPGFPRIFYLKYHGYTAYFPLWALARYRRLAGAQAAPSSPGPGTAATIADPAVA

SEQ ID NO: 106 - protein, 657 aa, Burkholderia ubonensis
MNDLTDMPTLAADSAAADLDAAVARATDALLAAQQADGHWVYELEADSTIPAEYILLVHYLGETPNLELEQKIGRYLRRIQQPDGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFIDPPVNAGLLPRQGHQSAGWFAFFRVVDHALRAVDGLFPSYTRERAIRQAVAFVDERLNGEDGLGAIYPAMANAVMMYDALGYPEDHPNRAIARRSVEKLLVVHDDEAYCQPCLSPVWDTSLAAHALLETGDPRAEDAVVRGLEWLRPLQILDVRGDWISRRPNVRPGGWAFQYANPHYPDVDDTAVVVMAMDRVEKLRHSDAYREAISRAREWVVGMQSSDGGWGAFEPENTQYYLNNIPFSDHGALLDPPTADVSGRCLSMLSQLGETAANSEAARRSLDYMLKEQEPDGSWYGRWGMNYVYGTWTALCSLNAAGLGPDDPRVKRGAQWLLSVQNKDGGWGEDGDSYKLDYRGYEQAPSTSSQTAWALLGLMAAGEVNHPAVARGIDYLIAEQKEHGLWDETRFTATGFPRVFYLRYHGYRKFFPLWALARYRNLKRANATRVTVGM

SEQ ID NO: 107 - protein, 657 aa, Burkholderia vietnamiensis
MNDLTDMANLSAGTVPAGLDASVARATDALLAAQNADGHWVYELEADSTIPAEYVLLVHFLGETPNLELEQKIGRYLRRIQQADGGWPLFTDGAPNVSASVKAYFALKVIGDDENAEHMQRARRAIHAMGGAEMSNVFTRIQLALFGAIPWRAVPMMPVEIMLLPQWFPFHLSKVSYWARTVIVPLLVLNAKRPLAKNPRGVRIGELFIDPPVNAGLLPRQGHQSPGWFAFFRVVDHALRAADGLFPSYTRERAIRQAVSFVDERLNGEDGLGAIYPAMANAVMMYDVLGYPEDHPNRAIARKSIEKLLVVHDDEAYCQPCLSPVWDTSLVAHALLETGDARAEQAVLRGLDWLRPLQILDVRGDWISRRPNVRPGGWAFQYANAHYPDVDDTAVVVMAMDRAQKLQNTDTYRESIARAREWVVGMQSSDGGWGAFEPENTQYYLNNIPFSDHGALLDPPTADVSGRCLSMLAQLGESALSSEPARRALDYMLKEQEPDGSWYGRWGMNYVYGTWTALCSLNAAGLGPEDPRVKRAAQWLLSIQNKDGGWGEDGDSYKLNYRGFEPAPSTASQTAWALLGLMAAGEVNHPAVERGIGYLIAQQNDEGLWDETRFTATGFPRVFYLRYHGYRKFFPLWALARYRNLKRANATRVTVGI

SEQ ID NO: 108 - protein, 678 aa, Burkholderia xenovorans
MNDLSQTQPRDAVLPEAAGAVPPASAPAPAAASEAPAASLDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 109 - protein, 657 aa, Candidatus Koribacter
MDDRHIQSEITFGKIDGIRERIQQAMDAAKRYLFSKQDPEGFWCGELEADTTLQSDYIVMHTLLGTGDPVKMQKAGKQILQHQNPDGGWNIYPDGPSNISAAVKAYFSLKLIGHKPDEPEMTKAREWILAHGGVTACNTFSKMYLCFFGQYDYDTVPAIPPEIVLFPNWFWFNLYEISSWSRGILVPLAICYAKKPFKKIPDEANIDELFVEGRHANLHLTWDKKPFSWRNFFLVLNNMVHFFERVHVRPLRKLAMKRAEKWMLERLEMSDGLGGIYPAILNSIIALRALGYSTDDPQVIRAMDEFEKLGIEEDDTFRMQPCMSPVWDTAYALYALGEAGVPGSDPRMQKAAEWMLKKQVTHKGDWAVKVRNVQPGGWYFEFNNEFYPDVDDTAQVILSLNHVRTSNERYQDDTVKRALDWQLAMQCKNGGWASFDKDNNKMVFQYIPFADHNAMLDPATVDITGRVLEALSHHGYSLKDKVVQRAVKFIQSEQEPDGSWFGRWGVNYIYGTMLCLRGLAAVGVDHHEPMVQQAAEWLRMVQNPDGGWGESVGSYDDPKLRGQGPSTASQTAWAVMGLLAANDLRSDSVTRGIAWLLENQKPNGSWWEKWITGTGFPRVFYLKYTMYAEYFPLIAFAEYLRRLNTPLDEKVKLGPQA

SEQ ID NO: 110 - protein, 488 aa, Candidatus Kuenenia
MILFPAGFYFSIYEISYWSRCIVVPLSIAIARKPHVTVGDDLLKELYLVPREDVVYRIERDQDGFCWYNFFIDADSIFRRYEQHPIKFIRRIAKKMAEKWLLEHMEKSGGLGAIWPAMINSIFAMKCLDYPDDHPALTAQMKEVEALVIYEGDMLYLQPCVSPVWDTAWSIIAMNDSGIPGSHPVLQKAGKWLLSKEVRDFGDWKLKCKVEEPSGWYFQYANEFYPDTDDTGAVLMALQRVSLPEDMHKEKTLLRALRWLQAMQCDDGGWGAFDRNNNKTILNNIPFADFNALLDPSTSDVTGRCIEFFGRIGFNKTYLNIKKAVEFLKKEQDEDGSWFGRWGSNYIYGTWSVISGLIAVGEDINKAYIKKAIAWLKSVQNSDGGWGETIKSYEDSALKGIGKSTPSQTAWALLTLITAGEIKSSSTERGIDFLLSTQKEDGSWDEREFTATGFPKVFYLKYHMYRNYFPLMALGRYRHFTHKLATSQ

SEQ ID NO: 111 - protein, 641 aa, Candidatus Solibacter
MSYEWTEPVRPGRRHAVSPVQNFCQSLAPAIQRACDALFSQQAADGFWCGELTADTTLESDYILLQLWLNQPDDHGWNPPTRPRIDRAGRSILERQLPDGGFNIYAGGPSEVSATIKAYCALKLAGLDPHSPPLRRARERILALGGLQAANSYVKINLSLFGLYPRKHVPSVPPEIVMLPGNVLYEMSSWTRSILVPLSIVQARGSNRRAPNGFNLDELLLPGVKLALPKRKGLAVLFHHLDRMFKVWEKRGSERIRGAAIREAERWLIARTHYTEGLGAIYPAMMYFIMALDALGYAEDHPDRSEAIRHFESLLIETDDRFLFQPCVSPVWDTAICAFALGEAGNTDDPRMTLAADWLISKEVRRKGDWSIKRPDTEPSGWAFEFANEFYPDIDDTAMVLLALMHANGSNPEAQAAAERRAVNWLLAMQSSDGGWAAFDVDNNWAMLNQVPFADHNAMLDPTCPDITGRVLECLCRRGMAGHDAARRGVAYLLQAQEKDGSWYGRWGVNYIYGSFLAMRGLTTSGAPGSQDAVDRAARWLRAIQNPDGGWGESCASYARDGYVAAPSSASQTAWALLGLCAAGDRDSAQFRRGVEYLLTLQAPDGKWPEGATTGTGFPNVFYLTYAMYRDYFPLLALSQV

SEQ ID NO: 112 - protein, 641 aa, Candidatus Solibacter
MSAPSHVGNTLEHAAELATRKAMAYLTCLQERDGHWCAELTADTTLESDYILFQLWLYPPQDGKWEPETRPLIRKAVNSILERQLPDGGFNICVGGPSEVSASVKAYVAMKLAGLPPEDDRMARLRERILALGGIQAANSYVKVNLSLFDLYPREFSPSIPPEVALLPFDLLYQMSAWTRAIVISLGIVHAANPRRPAPAGFNLQELWLPGVSPEFRRDPSFFTWHNTFLTVDKALKLWERYGSKAVRRRAVEKAKTWMIERLHHSDGLGAIYPPMMYSVMALDVLGYAKDDPLRVEALRHFNNLMVDDGDRFFFQPCFSPVWDTAIGAYALVQADPSHEAIAPAADWLIAKEVRRKGDWSVKRPNTEPSGWAFEYSNEYYPDIDDTAMVMLALGETRASNTEAQAAACKRGLAWLLAMQSSDGGWAAFDADNNWEFLSQVPFADHNAMLDPTCADITGRVLEALASQGLDRNHKAVRRGAEWLIRHQENDGSWYGRWGVAYIYGTCFALRGLAASGENDREAHILRAGEWLRSIQNADGGWGESCKSYDNRIFTGGPSTPSQTAWAILGLIAGGDANSLSVQHGIEYLLETQRSDGSWDEQFATGTGFPRVFYLNYHMYKDYFPLLALASFVKARAGSNG

SEQ ID NO: 113 - protein, 644 aa, Catenulispora acidiphila
MTDVIDKAVAATGPADPSQGAAATLQAAADHLLGLQDDAGWWKGELETNVTMDAEDLLLRQFLGIRTEEVTREAGDWIRSQQRADGTWANFFDGPADLSTTIEAYTALRMAGDAKDAEHMRAARTYILDSGGIEASRVFTRIWLALFGEWQWSDLPVMPPELIYLPKWFPLNVYDWACWARQTVVPLTIVNALRPVRPLGFDLKELRTGRRAPAQRGLFSTLDRALHVYERKPLRSVRDAALRRSADWIIARQEADGSWGGIQPPWVYSLMALNLLGYGVDHPVMRKGIEGLDRFTIRDERGRRLEACQSPVWDTVLAMTALRDAELPENHPALVKAADWVLGEEITNPGDWSVRRPRVAPGGWAFEFDNDGYPDVDDTAEVVLALNRVAHPDAPAAIRRGVDWLEGMACKDGGYGAFDADNTRTLALKLPFCDFGAVIDPPTADVTAHTLEAYAALGLANSRASQRALEWLVKAQERDGSWFGRWGANHVYGTGAVVPAMVAVGVDPEDEMIRRAVRWLEEHQNDDGGWGEDLRSYRDKSWIGRGVSTASQTAWALLALLAAGEERGTAVEQGVRFLIRTQRADGTWDEDHYTGTGFPGDFYLNYHLYRLVFPISALGRYVRAVGAAGDGGDAGHAGHAGTVS

SEQ ID NO: 114 - protein, 657 aa, Chthoniobacter flavus
MIFTDTPTGSTQNRLDVAIRRAQQNLLRLQHNEGYWCGELFVDSTLCSDYVLFMHWADEIDPVMEEKCVAHIRRRQLEDGGWNIYEGGPSDVNATVKAYFALKLAGHAPTQPWMQEARACILRLGGIPKMNTYAKLYLALLGQFPWRYLPTVPVEIMFMPRWFFFDIYEVSSWSRAMLMPLAILNHYKPTKHLPADKQLHELYPIGSEESDLGLGMQKPRFSWPNFFLFCDRLIKIMHSLPWKPWKRAALARAEAWMTQRMGEGSDGLAAIFPAMLNSMIALRTLRYSREHPLYVKAKNDFAGLFVDDPQDFRIQPCLSPVWDTAINLVALLESGLDPHDPKIEAAVNWLKEKEVRINGDWYVKNHHVPPSGWAFEFNNVYYPDTDDTMMVLAALARAGAHEESAPVETKAMFERALKWLLSFQCRDGGWAAFDKDVTQGWLEDVPFADHNAILDPTCSDLTGRVLELLGLIDYDRNCTPVRRALKFLRDTQEDDGSWYGRWGVNYIYGTWQVLRGLRSIGEDMRQQWIVRARDWLESCQNEDGGWGETCASYDDPTLKGKGPSTASQTAWALMGLIAAADPTEPGAFDRKSIRQGVDYLLSTQVADGSWVEPEVTGTGFPRVFYLRYDMYRNNFPLMALATYRKAREGKLPVRQRE

SEQ ID NO: 115 - protein, 603 aa, Chthoniobacter flavus
METLSRSRLEAALAKATQALLTELNPAGHWSGELSSSALSTATAIVALGAVDREQQRELIAGGMRWLAQHQNADGGWGDTVKSRSNISTTALCWAAVSTSTEHAESAAKAEAWLTRAAGSMAQLVPAIEARYGKDRTFSVPILMHLAICGRVSWSQIPALPFELAALPHQLFGALQLPVVSYALPALIAIGQAIHHHAPPTNPLLNGLRKSARARTLEVLESIQPQNGGFLEATPLTSFVTMALASAGEAQHPVARRGVSFLQASVQRDGSWAIDTNLATWVTTLSIKALAHQPGALSPERALTLREWLLGQQYVVEHPYTHAAPGGWAWTDLPGGVPDADDTPGALLALLHLGVVDAPTRQAGQIGVRWLLDLQNRDGGIPTFCRGWGALPFDRSSPDLTAHTLRAWTAWLPQLDESLKRRTLRAVTKAIHFLATHQRTDGSWLPLWFGNEHAPDDENPLYGTAKVVIALRELLNRDFTLPNGMLERALCWLVERQDISGGWSGAKNGPVSVEETALAVEALAGTGHVSATDRGAAWLTEQIEADTWREPAPIGFYFAKLWYYERLYPQIWTVGALGRVAALRVGESESDTPAGLHRATSET

SEQ ID NO: 116 - protein, 645 aa, Crocosphaera watsonii
MQTQDRLTQKQPLSLKDAITASQNYLLSLQYPQGYWWAELESNITLTAETVLLHKIWGTDKTRPLHKVEAYLRQQQREHGGWELFYGDGGEISTSVEAYMALRLLGVPQDDPALIRAKDFIISKGGISKTRIFTKFHLALIGCYDWKGIPSIPPWIMLFPDSFPFTIYEMASWARESTVPLIIVFNDKPVFSVDPVFNLDELYAEGVENVKYELPKNNNWGDIFLGIDQVFKFAEQVDLVPFRKEGLKAAEKWILNHQQETGDWGGIMPPMLNSLLAFRTLNYDVNDPSVKLGFEAIDRFSIEEDDTYRLQACVSPIWDTAWCVRALTDSGLEKDHFSLVKAGKWLLDKQVMEYGDWAVKNKAGKPGGWAFEFTNRFYPDLDDSATVVMALNGIKLPDEARKQAAINRCLQWIETMQCKEGGWAAFDLNNDQAWLNEVPYGDLKAMIDPNTADVTARVVEMLGSCDLEIESDRLNKSLNYLYKEQEKDGSWFGRWGVNYIYGTSGVLSALAVINPEKHKTQMEQGINWLLSCQNKDGGWGETCRSYNDPSLKGKGVSTPSQTAWSLIGLLDAGEALNKFETDAIERGVNYLLDTQTEEGTWEESEFTGTGFPCHFYIRYHFYRHYFPLIALGRYQNLSSEFGVRS

SEQ ID NO: 117 - protein, 681 aa, Cupriavidus taiwanensis
MNETAFANPAPQVGPAQRQPAAPQEAPAARLPAPALDRGIDRALDALLHQQRPDGHWVYELEADATIPAEYVLMVHYLGEDPDRDLEARIARYLRRIQNPDGGWPLFHQGRSDISASVKAYFALKMAGDDPQSAPMQRARQAIHAMGGAEATNVFTRTLLALYGVLPWKAVPMMPVEIMLLPRWFPFHLSKVSYWARTVIVPLLVLNSLRPQARNPRGVGINELFVGNCHTVGLPPRAAHQHAGWYTVFRGLDALLRLAEPLFPRTLRRRAIAAAQRFVRERLNGEDGLGAIFPAMANSVMMFDVLGVPPEDPARAVARRSIERLLVEHGDEAYCQPCLSPVWDTALATHALLETGEARAAQAAGRALDWLRPLQVLDLRGDWAVRRPLVRPGGWAFQYANAYYPDVDDTAVVAAAMDRFMRAHHAPGRYGEAVARATEWIVGMQSGNGGWGAFEPENTHLYLNNIPFADHGALLDPPTADVSARCLSMLCQTGATPANSEPAARALRYLLAEQMPDGSWFGRWGTNYIYGTWSALCALNAAGLPPEAPELCRAVAWLARIQNADGGWGEDGSSYRLDYSGYEPAPSVASQTAWALLALMAAGAAQHPAVARGIDYLLRTQQPGGLWHEPRFTAVGFPRVFYLRYHGYARYFPLWALARYRNLQRGLGDHGGNSGQVAWGL

SEQ ID NO: 118 - protein, 663 aa, Cyanothece sp.
MLTYKEYRRSVTEIAMQTRDRQTQKPALSLNDAITASQNYLLSLQYPQGYWWAELESNITLTAETVLLHKIWGTDKTRPLHKVEAYLRQQQREQGGWELFYGDGGEISTSVEAYMALRLLGVPQDDPALIRAKDFILSKGGISKTRIFTKFHLALIGCYSWKGIPSIPPWIMLFPNSFPFTIYEMASWARESTVPLIIVFNDKPVFAVDPIFNLDELYAEGIENVKYELPKNNNWGDIFLGLDKVFKFAEQVDLVPFRKKGLQAAERWMLNHQQETGDWGGIMPPMVNSLLAFRVLNYDVNDPSVQRGFEAIDRFSIEENETYRVQACVSPVWDTAWCVRALTNSGLPKDHFSLVKAGKWLLEKQCLEYGDWAVKNKTGKPGGWAFEFTNRFYPDIDDSAVVVMALNGIKLPDEARKQAAINRCVKWIETMQCKEGGWAAFDVDNDQAWLNEVPYGDLKAMIDPNTADVTARVVEMVGSCDLEISSKRLNKALNYLYKEQEKDGSWFGRWGVNYIYGTSGVLSALAVINPEKHQPQIEQGINWLLSCQNKDGGWGETCWSYNDSNLKGKGISTASQTAWALIGLLDAGEALNHFETDSIQRGISYLLNTQTEEGTWEESEFTGTGFPCHFYIRYHFYRHYFPLIALGRYQNLSSEFGIRNSEL

SEQ ID NO: 119 - protein, 643 aa, Cyanothece sp.
MQIQDRNSSPQVTEVLNQVKDAIAASQDYLMSIQYPEGYWWAELESNVTITAEVVLLHKIWGTDKTRPLHKVETYLRRQQREHGGWELFYGDGGDLSTSVEAYMALRLLGVSIDDPALIRGREFILKRGGISKSRIFTKLHLALIGCYDWRGIPSIPPWIMLLPENFPFTIYEMSSWARSSTVPLLIVFDKKPVYCCDPTINLDELYSEGIENVKYDLPKTGDWTDIFVWLDGVFKFAQDYNLVPLRQESLQAAERWVLERQEDSGDWGGIIPAMLNSLLALRALNYEAVDPIVHRGLQSVDNFAIETEDTYHVQPCISPVWDTAWAIRALVESGLKADDPRLVKGAQWLLDKQILDYGDWAVKNKQGTPGGWAFEFDNRWYPDLDDSAVVVMALDQVKMPNEDLKNGAIRRCVRWMATMQCKDGGWGAFDLDNDQNWLNFLPYADLKAMIDPNTSDVTARVLEMLGTCGLIMDSNRVQKAIAYLEKEQEPDGSWFGRWGVNYIYGTSGVLSALAVIAPETHQKELKKGAAWLVGCQNADGGWGETCFSYNDSSLKGKGDSTASQTAWGLIGLLAAGEATGEFFKTAIERGVNYLLKTQREDGTWDENYFTGTGFPCHFYLKYHLYLQYFPLIALSRYQRLLT

SEQ ID NO: 120 - protein, 651 aa, Cyanothece sp.
MQTQNRVTSTQKVELSNLTQAIIASQNYILSRQYPEGYWWGELESNITLTAETVLLHKIWKTDKTRPFHKVETYLRRQQNEQGGWELFYGDGGELSTSVEAYMALRLLGVTPEDPALIRAKDFILSKGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAEKWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENRKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDSSLKGTGISTASQTAWAIIGLLDAGEALETLATDAIKRGIDYLLATQTPDGTWEEAEFTGTGFPCHFYIRYHLYRHYFPLIALGRYWKIGLKTPSVIPLN

SEQ ID NO: 121 - protein, 647 aa, Cyanothece sp.
MQTQNRVTSTQKVELSNLTKAIIASQNYIMSRQYPEGYWWGELESNITLTAETILLHKIWKTDKTRPFHKVETYLRRQQNEQGGWELFYGDGGELSTSVEAYMALRLLGVTPEDPALIRAKDFILSQGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAERWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENCKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDPSLKGTGVSTASQTAWALIGLLDAGEALETLATDAIKRGINYLLDTQTPDGTWEEAEFTGTGFPCHFYIRYHLYRHYFPLIALGRYWKIGLKNLKG

SEQ ID NO: 122 - protein, 643 aa, Cyanothece sp.
MQIQARNISTKVTEVFSKVKEAIAASQQYLLSIQYPEGYWWAELESNVTITAEAVLLHKIWGTDTTRPLHKVETYLRRQQREHGGWELFYGDGGDLSTSVEAYMALRLLGVSASDPALVRAKAFILSRGGISKSRIFTKMHLALIGCYDWRGVPSIPPWIMLLPENFPFTIYEMSSWARGSTVPLLIVFDKKPVYQCGITLDELYSEGINHVRYDLPRNGDWTDVFVWLDGVFKFAETNNLIPFRNESLKAAERWVLERQEDTGDWGGIIPAMLNSLLALRALDYEVNDPIVHRGFKSVDNFAIETEETYHVQPCISPVWDTAWVLRALVESGLKPDEPVLVKGAQWLLDKQILDYGDWAVKNKEGTPGGWAFEFDNRWYPDLDDSAVVVMALEQVKMPDEQLKYGAMRRCVRWMATMQCKAGGWGAFDVNNDQNWLNYLPYADLKAMIDPNTADVTARVLEMLGTCELSMDHDRVKRAIAYLEQEQEADGSWFGRWGVNYIYGTSGALSALAAIAPVTHQAQIEKGAAWLVGCQNPDGGWGETCFSYNNPALRGKGDSTASQTAWGLIGLLAAGEATGKFAKTALERGVNYLLATQRPDGTWDESYFTGTGFPCHFYLKYHLYLQYFPLIALSRYQRLLGFN

SEQ ID NO: 123 - protein, 640 aa, Cyanothece sp.
MQTRDRQTHKPALSLNDAITASQNYLLSLQYPQGYWWAELESNITLTAETVLLHKIWGTDKTRPLHKVEAYLRQQQREHGGWELFYGDGGEISTSVEAYMALRLLGVPSNDPALIRAKNFIISQGGISKTRIFTKFHLALIGCYSWKGIPSIPPWIMLFPNSFPFTIYEMASWARESTVPLIIVFNDKPVFAIDPIFNLDELYAEGIENVKYELPKNNNWGDLFLGLDKVFKLAEQVDLVPFRKQGLQAAERWMLDHQQETGDWGGIMPPMVNSLLAFRVLNYDVADPSVQRGFEAIDRFSIEENDTYRVQACVSPVWDTAWCIRALTDSGLPKDHFSLVKAGKWLLEKQVLEYGDWAVKNKTGKPGGWAFEFTNRFYPDIDDSATVVMALNGIKLPDEALKQAAINRCLKWIETMQCKAGGWAAFDVDNDQAWLNEIPYGDLKAMIDPNTADVTARVVEMVGSCDLEMSSDRLNKALDYLYEEQEKDGSWFGRWGVNYIYGTSGVLSALAVINPKQHKSQIEQGMNWLLSCQNEDGGWGETCWSYNDLSLKGKGVSTPSQTAWALIGLLDAGEVLNHFETDSIERGINYLLNTQTEEGTWEESEFTGTGFPCHFYIRYHFYRHYFPLIALGRYQQMLGS

SEQ ID NO: 124 - protein, 668 aa, Cyanothece sp.
MQIRATVDTAKLEKAIAASQEHLLSTQYPEGYWWAELESNVTMTAEVVLLHKIWKTDGTRPMHKAEKYLRSEQREHGGWELFYGDGGDLSTSVETYTALRLLGVPASDPALLKAKDFILRRGGISKTRIFTKLHLALIGCYDWRGLPSLPPWVMLLPENFPFTIYELSSWARGSTVPLLIVMDRKPVFSVNPQINVDELYAEGRDRVKFELPRKGDWTDLFIELDGLFKFTEQNNLVPFREEGLRAAERWVLERQEATGDWGGIIPAMLNSLLALRALGYHPADPYVRRGMAAVDRFAIETADTYRVQPCVSPVWDTALVMRGLIDSGLPADHPAIVKAGEWLLEKQILAYGDWAVKNKTGQPGAWAFEFENRFYPDVDDSAVVVMALQAAQLPDEDLKQQAIERCVKWIATMQCKPGGWAAFDVDNDQDWLNQIPYGDLKAMIDPNTADVTARVLEMIGRSGVTTGEASVERALAYLRREQEVEGCWFGRWGVNYIYGTSGVLAALALIAPKSDHAMIQRGADWLVRCQNADGGWGETCRSYNDPHLKGQGPSTASQTAWALIGLLAAGEATGEFAWGAIDRGINYLLATQQQDGRWDEDWFTGTGFPGHFYLKYHLYQQHFPLTALGRYSSLTGLKQELKIPLQLKSKPEVVMIEDSDLLSDEDAT

SEQ ID NO: 125 - protein, 651 aa, Cyanothece sp. PCC 8802; identical to SEQ ID NO: 120

SEQ ID NO: 126 - protein, 705 aa, Desulfovibrio salexigens
MNKKSAMKLKKKAKNHVVSLLQPTDALNRVMKRFRSLQSPEGYWVFALEADVTIPSEYIMFNRFLGRKMDKGLAERLGNYIRAKQMADGGWPLHDNDGPVNISASVKAYMALKMLGDNKDAEHMVRARQIILAKGGAETANVFTRICLATFGQIPWHCPPAMPIEIVLLPKWFFFHLDKVSYWSRSVIYPLLIIYAKQPVCRLRPEEAVPELFCKPAEEHIHIDKYRDKGWRKNLFILLDRVLKRTIHLVPKSINKKALNYAEKWTREHMAGRGGIGAIFPAMANAVMALSLLGYDESDPDFARGMQSVDDLMVDKFHVPEKSPWEHTVITGGAELSAAPELDISPDHGTAENLEQAMCQPCNSPIWDTCLTLSAMMEAGENQDSKSTQQALNWLWDQQIFFRGDWISKAPKLEGGGWAFQFENTFYPDLDDTAMVLMAMCRAGVLDQPEHRENFIKGVNWLIGMQSSNGGWAAFDIDNCAEYLNDIPFADHGALLDPPTSDLTARVIELLGVLGYDKSFRPIKDGIEFLKKEQEDDGSWFGRWGVNYIYGTWSVLCGLRQAGEDMNSSYVCKAVEWFENHQNKDGGWGESCLSYNDKNYAGLGDSTASQTAWALLGLMAAGRVHSKAVSRGVRYLLDTQKDDGSWDESLFTGTGFPRVFYLRYHGYSQYFPMWALGVYQRFSADEDTKQIMMRRKSPLDLGRKW

SEQ ID NO: 127 - protein, 685 aa, Dryopteris crassirhizoma
  misc_feature (145)..(145): Xaa can be any naturally occurring amino acid
MLPYNQDFYNEDEALKDDHCEGAGNVSNPPTLDEAIKRSQDFLLSQQYPEGYWWAELEGNPTITSHTVILYKILGIEDEYPMDKMEKYLRRMQCIHGGWELFYGDGGQLSVTIESYVALRLLNVPPTDPALKKALKFIIDKGGVXKSRMFTKICLALLGCFDWRGIPSLPPWVMLLPGWFLSSIYETACWARGCVVPLIVVFDKKPVFKVSPEVSFDELYAEGREHACKTLPFCGDWTSHFFIAVDRVFKMMERLGVVPFQQWGIREAEKWLLERQEDTGDFLGVYPPMFYSVVCMKTLGYEVTDPVVRRALLSFKKFSIERADECSVQSSLSPVWDTALVVRSLVESGLPPDHPALQRAGEWLLQKQITKHGDWSFKNQSGVAGGWAFQFFNRWYPDLDDSAVVVMALDCLKLPNEDVKNGAITRCLKWISSMQCKGGGWAAFDKDNHQHWINSTPFSDLKAMVDPSTTDISARVLEMVGRLKLHGTSFDEAHFLPPESIARGLVYLRREQENEGCWFGRWGVNYIYGTCGALVALSLVAPMTHEEEIARGARWLVQVQNMHGKKINGPQDGGWGETCFSYNDPALKGQGDVSTASQTAWALQGLLAAGDALGKYEVESIGHGVQYLLSTQRKDGSWHESQFTGGGFPIHFYLRYHFYAQHFTLSSLARYRTRLQASKIKPPIP

SEQ ID NO: 128 - protein, 747 aa, Frankia alni
MPDLELRDVDRADGRHHAPNLGRTDTLSPSAPTGEPAPASTPAAVATPTPTPTTAPAPAPAPENALRETVQRAAEHLLRLQDPRGWWKFDLETNPTMDAEDLLLREYLGIRTVEQTEATAKHIRSRRLDDGSWPTYFGGPGELSTTVECYIALRLAGDSPDDEPLRRSAAWIRERGGIPATRVFTRIWLALFGWWRWEDLPVLPPEIMFLPPRAPLSIYSFASWARQTIVPLTIVSAARPQCPAPFDLAELDPDEVPAAQSHGAAQSPDTRSPAGGRTLRGAMRRLGGDRPNTAKVFFRGLDAALHRYHRHPIGPLRRHALRTAERWIIARQEADGCFGGIQPPAVYSIIALRLLGYDLDHPVLAAALRSLDAYTLHREDGSRMIEASQSPIWDTALAVLALADAGIDAPADVDVAPALPTQRVATGAPAPSAPVPTALERAADWLLGQEIQHRRGDWAITHPGVAPGGWAFEFDNDTYPDTDDTAEVVLALHRLNRLRRLRHPTNTRIDAALERSTAWLFALQSRDGGWGAYDSDNASTLVYQIPFADFGALTDPSSADVTAHVVELLCETGRIRDPRTLRGVDWLLRNQEADGSWYGRWGVNYVYGTGSVLPALQAAGLPPTHPAMVAGARWLLSRQNSDGGWGEDIRSYGDPAWSGRGLSTPSQTAWAMLGLLATDHGGVHADALAAAARWLTEQQRPDGGWDEEMFTGTGFPGFFYLNYHGYRLVWPVMALGRYLHSRQHPSD

SEQ ID NO: 129 - protein, 704 aa, Frankia alni
MSLTSDPSPAAPTAEKSPKRPTIPVPATADAYGISRSSPPLPAATGRPQAAGPASAGVATARARDHLLALQSEEGWWKGDLETNVTMDAEDLFMKQFLGIRGDDETEQTARWIRSQQLADGGWPTFYGGPADLSTTIEAYIALRLAGDAVDAPHMARAAELVRAQGGVAASRVFTRIWLAALGQWSWDDVPVIPPELIFLPSWIPLNVYDFACWARQTIVALTIVGSLRPSHDLGFSIDELKVPAAARKPAALRSWEGAFERLDKLLHRYEKRPIKLLRTLALRRATEWVVARQEADGCWGGIQPPWVYSVMALHLMGYPLNHPVIATAFRGMERYVIRRDTPQGPIRQIEACQSPVWDTALAVVALADAGVPGDHPAMVKAGRWLVDEEVRVAGDWAVRRPELAPGGWAFEFDNDFYPDVDDTAEVVLALRRLLGAGHVAPPASRQGRAEAPPVNTVEDADPRLAAAMRAAAARGVDWSVGMRSSNGAWGAFDADNVRTLTTKIPFCDFGEVVDPPSADVTAHIVEMLADLGRSDHPITQRAVQWLLDNQEPGGSWFGRWGVNHLYGTGAVVPALIGAGVPTDHPAITAAVRWLLEHQSPEGGWGEDLRSYTDPAWIGRGELTASQTAWALLALLAVDPHSLAVKRGVRWLCETQRPDGTWDEPYFTGTGFPGDFSLNYHLYRLVFPLTALGRYVSLTGVATP

SEQ ID NO: 130 - protein, 741 aa, Frankia sp.
MSLTSDPSPAAPKAAKSSKRVNIPAPATPDAYGISRSSPPLSGGGVSGGGVSGGGAATADGTPPTTQTSVDPDLAAAMTAANQARDHLLGLQSEEGWWKGDLETNVTIDAEHLFMKQFLGIRTEEETEPIARWVRSQQLADGGWATYYGGPAELSTTVEAYIALRLAGDEPDAPHMAAAAALIRSQGGVAAARVFTRIWLATFGEWSWDDVPVLPPELIFLPSWFPLNVYDFGCWARQTIVALTIVGSLRPVRDLGFSIDEIKVAAPVTPPKPAPLHSWEGAFERLDAILHRYERRPIKVLRTLALRRATEWVVARQEADGCWGGIQPPWIYSVMALHLMGYPLNHPVIATAFRGMERYIIRRETPEGPTAQIEACQSPVWDTALAVVALSDAGVPADHPAMVRAGRWLVDEEVRVAGDWAVRRPALAPGGWAFEFDNDFYPDTDDTAEVVLALRRLLGGSHVTPGGTVTPSGSVTPGGTAELSPAARDRASRGLAAVDPQLAGAMRAAAARGVDWSVGMRSSDGAWGAFDADNVRTLTAKIPFCDFGEVVDPPSADVTAHIVEMLADLGRSDHPITRRAVQWLLDNQEPGGSWFGRWGINHVYGTGAVVPALIAAGVPADHPAITAAVRWLLEHQSPDGGWGEDPRSYDDPAWIGRGELTASQTAWALLALLAVDPHSKAVKRGVRWLCETQRPDGTWDEPQFTGTGFPGDFYLNYHLYRLVFPLTALGRYVTLTGVATP

SEQ ID NO: 131 - protein, 728 aa, Frankia sp.
MSLTSDQSSAAPTAAAQSPKIPNPSVARPSADAGSFETAGAVRTDSVSIDSVSTGTPVDPVVGAMRRGRDHLLSLQAEEGWWKGELETNVTMDAEDLMLRQFLGILTPSTATETGRWIRSQQLSDGGWATFYGGPSDLSTTIEAYVALRLAGDDPDAPHMRSAAEWVRSAGGIAASRVFTRIWLALFGEWSWDDVPVLPAEMTFLPPWFPLNIYDFACWARQTVVALTIVGSLRPVRSFGFTLDELRVQAPKATKAPLRSWAGAFERLDSVLHRYEKRPFQPLRRLALRRAAEWVIARQEADGCWGGIQPPMVYSIMALHLMGYPLNHPVISMAFRALDRFTIREETPEGTVRRIEACQSPVWDTALAVVALADAGLGGDHPAMVRAGRWLADEEVRVAGDWAVRRPTLAPGGWAFEFDNDFYPDVDDTAEVVIAIRRLLGDGHGPVDHSDGSGPGSAAATAASAAAEAAVAAAGTIAAADPELAARLRAAAERGVDWSVGMRSSNGAWAAFDADNVRTLVRKIPFCDFGEVVDPPSADVTAHMVEMLALLGRSDHPITQRGVRWLLDNQEAGGSWFGRWGVNHVYGTGAVVPALISAGVDAEHPAIVSSMHWLVEHQTPEGGWGEDLRSYRDDEWIGRGEPTASQTAWALLALLAAEPASGTAEWEAVERGVRWLCDTQRPDGTWDEPQFTGTGFPWDFSINYHLYRLVFPVTALGRYVTLTGRSTS

SEQ ID NO: 132 - protein, 689 aa, Frankia sp.
MFQGSDRPPVTLVMNDMRGPDMNVSDTVSVTRESIPTQTSAGDATARDLTAAVGSELTRALRLATDHLLALQDGTGWWKFDLETNTSMDAEDLLLREYLGIRTTEVTAASARFIRSRQSDDGSWPQYFGGPGELSTTVESYIALRLAGDDASAPHMLSAATWVRDHGGVPATRVFTRIWLALFGWWRWEDLPALPPEIMLLPRRAPLNIYSFGSWARQTLVSLTVVSALRPVRPAPFDLDELYPDGPASAWSGAGPSNVLERISTRFTAKEIFLGIDRLLHVYHRRPVRSMRNHALRAAERWIIARQEADGCFGGIQPPAVYSIIALRLLGYELDHPVLKAALRALDDYSVTLPDGSRMVEASQSPVWDTALAVNALADAGATAAIAPDHPALVRAAGWLLGQEVRHRRGDWAVNHPDVPASGWAFEFENDTYPDTDDTAEVLLALRRVRHPARDELDAAERRAVAWLFGLQSSDGGWGAYDADNTSTIPYQIPFADFGALTDPPSADVTAHVVELLAEAGLGGDDRTRRGVDWLLDHQEADGSWFGRWGVNYVYGTGSVMPALRAAGLEPSHPAMRAGADWLLTHQNADGGWGEDLRSYTDPEWSGRGESTASQTAWAMLALLTVGDQPEVSGALARGARWLADHQRPDGSWDEDQFTGTGFPGDFYINYHGYRLLWPIMALGRYLRG

SEQ ID NO: 133 - protein, 773 aa, Frankia sp. EuI1c
MTTTDETALAAGTPKAAFAPAPRGAADDLVARTVAVEAPPSPAPASDDTLARAVAHLKSLQDEAGWWKGDLETNTTMDSEDLMLRHWLGIWNPEQAERTARFIRSKQYADGSWPIYHAGPGDLNATVESYVALRMVGDSPQDPHMRAAAAWARARGGVPATRIFTRIWLALFGWWRWEDLPVLPPELIFVPAKMPLSIYKFASWGRQTIVAIMVLMAHRPAGTPPFPIAELFPPPATKKKAAAQRKAQKKAGHAGGPTAWRDSSIDDMFTEPAPGTDTLRQPAALAIGPARPAPAKGRRGKGQPAAPDVMGRAKDGGGPGLPLPARLVSRVGFRTRRALRQAALDHVNWNLLFGGIDRFLHVYHRHPIRPVRSLALGLAERWIVVRQEADGCFGGIQPPTVYSIMALRVLGYPMDHPVMTAALRSLDEYSVTLPDGARMQEACQSPVWDTCLATIALADAGVPRDDPSLVRAADWMLAEEVRERRGDWSVPIPDVPTGGWSFEFDNDTYPDVDDSAEVMLALMRVAHPRPEKVVAATYRGLQWVFGMQCADGGWGAFDVDNAGELVYKIPFADFGMLTDPPSADVTAHVVELLGELGLGDDPRTKRGVEWLLHSQEADGSWYGRWGVNHLYGTGGVVPALRAAGLPASHPAIQRAADWLVAKQNPDGGWGESCYSYDEMSTAGVGVSTASQTAWALLALIAAGRVGDGVTGEAAARGVAWLAETQTAEGTWDEDYFTGTGFAGYFYINYHLYRLVWPVMALGRYQAALAGKGH

SEQ ID NO: 134 - protein, 764 aa, Frankia sp. EuI1c
MSLTSDPSPATPATQPTSARPGSLSDRRSRSGGSAVAGPVLVTTRPVAPVAKSGAVTPTATSGAVTSTATSGPALLPDLATDLADPTGPLAGAASATVRAAGGAGTRTQQTGQLGSTELAGPQADQVADRAAAVLGRARDHLLGLQSEAGWWKGELETNVTMDAEDLMLRQFLGILPPELAAETGRWIRSKQQDDGGWPTFHGGPSDLSTTFEAYVGLRLAGDLPDAPHMLAAASFVRAHGGLAATRVFTRIWMALFGEWPWDEVPVLPPELVLLPSWVPLNVYDFGCWARQTVVALTIVGHFRPVRSLGFSIDELRVAAVRPDRAPLVSWTGVFQRLDAGLRRYQRHPVKTLRELALRRATEWVLARQEADGGWGGIQPPWVYSIMALHLMGYSMDHPVLVAALDGLETFTVREQVREGDEVVTVRRLEACQSPVWDTALAVVALADAGLDARHPAMRKAGEWLVREEVTVPGDWRVRRPNLEPGGWAFEFANDIYPDVDDTAEVVLAVRRLLGSGWDDVDPTFAKQARASVERAVNWSVGMRSANGAWGAFDADNVRELATKIPFCDFGEVIDPPSADVTAHMVEMLADLGRADHPVTQRAVRWLLDDQEPGGSWFGRWGVNHVYGTGAVVPALISAGVAADHPAIRSAVRWLVAHQHPDGGWGEDLRSYQDDAWVGRGEPTASQTAWALLALLAADPMNEAVGRGVRWLCDTQLPNGTWDEPYYTGTGFPWDFSINYHLYRLVFPLTALGRYVTLTGRSAA

SEQ ID NO: 135 - protein, 612 aa, Gemmata obscuriglobus
MIPAERLRTAYRTARAALLAERVPEGHWVGELSTSALSTATAVMALHLVNPFTHRELIDAGRKWLAEHQNADGGWGDTVKSFSNISTTMLCRAAFKLAGEKEYPETVQRVEEYLSRNAGALPTARAAAIRARYGKDHTFSVPILMTCAVAKLVPWDEVPRLPFELACLPQSWYRFAKLPVVSYALPALIAIGQCIHHHRRSQNPIRNTVRRLARGLSLKVLRRIQPTSGGYLEATPLTSFVVMALSSIRRRRAAAEQQVIDEGVRFLVASVRPDGSWPIDTNLATWVTTLSVNALATAGDLEALDTKEQILAWLLKQQYKERHPYTGADPGGWAWTDLPGGVPDCDDTPGALIALAHLDPKSDPQAVLSGLRWVLRLQNGDGGAPTFCRGWGTLPFDRSGADLTAHSVRSLASWYRVWGAGPPPIEHLRHRLKDLEFPLSGLFWDVARRNPRFVRYLKKQQRSDGSWLPLWFGNQHAPDDINPVYGTARVLAAYRDLELKDAPECRRGIEFLLSVQNADGGWGGAKGCPSSVEETALAVEVLLDLADGDAVQKGVAWLAEAVESDRFRDASPIGFYFAKLWYFEKLYPIIFTVAALGRAVKITSPAPAAESA

SEQ ID NO: 136 - protein, 618 aa, Geobacillus sp.
MVADERSALIDALKRSQSVDGSWRFPFETGISTDAYMIILLRTLGIHDEPLIQALVERIESRQDANGAWKLFADEGDGNVTATVEAYYALLYSGYRKKTDSHMQKAKARILEVGGLERVHLFTKVMLALTGQHSWPRRFPLPLVFFLLPPSFPLNMYDLSVYGRANMVPLLVVAERRYSRKTDNSPDLSDLAASRNDWRLPDTEALWSYVKRSLTGLPAWLHRAAEQRAVRYMLEHIEPDGTLYSYFSSTFLLIFALLALGYPKDDPHIARAVRGLRSLRTEIDGHTHMQYTTASVWNTALASYALQEAGVPPTDRTIEKANRYLLSRQHIRYGDWAVHNPYGVPGGWGFSDVNTMNPDVDDTTAALRAIRRAAAKETAFRHAWDRANRWLFSMQNDDGGFAAFEKNVGKRFWRYLPIEGAEFLLMDPSTADLTGRTLEYFGTFAGLTKDHSAIARAIDWLLDHQEADGSWYGRWGICYVYGTWAAVTGLSAVGVPIDHPAMQKAVRWLLSIQNDDGGWGESCKSDGAKTYVPLGASTPVHTAWALDALIAAAERPTPEMKAGVRALVRMLHHPDWTASYPVGQGMAGAFYIHYHGYRYIFPLLALAHYEQKFGPFVD

SEQ ID NO: 137 - protein, 617 aa, Geobacillus sp.
MAGERSALITALKRSQAADGSWRFPFETGISTDAYMIILLRTLDINDEPLIQALVERIESRQEANGAWKLFADEGDGNVTATVEAYYALLYSGYRQPTDRHMQKAKRRILDMGGLDRVHLFTKVMLALTGQYPWPGRFPLPLEFFLLPPSFPLNMYDLSVYGRANMIPLLIAADSRYSRKTDKSPDLSDLFASRGDWGMPESRSLLTYVKRSLIGLPAQLHQAAKQRAVRYLFEHIEPDGTLYSYFSSTFLFIFALLALGYRNDDPRIRQAVRGLRSLRTTIDGHVHLQYTTASVWNTALASYTLQEAGVPMTDRAIEKANRYLLSRQNVRYGDWAVHNPYSTPGGWGFSDVNTMNPDVDDTTAALRAIRQAAAKETAFRHAWDRANQWLFSMQNDDGGFAAFEKNVSSRFWRYLPIEGAEFLLMDPSTADLTGRTLEYFGTFAGLTKDQRAVSRAVDWLLSHQERNGSWYGRWGICYIYGTWAAITGLTAVGVPAHHPALQKAVRWLLSIQNDDGGWGESCKSDGAKTYVPLGDSTPVHTAWALDALVAAAERPTLEMKAGFRALFRLLHHPDWTASYPVGQGMAGAFYIHYHSYRYIFPLLALAHYEQKFGPLDD

SEQ ID NO: 138 - protein, 618 aa, Geobacillus sp. Y412MC52; identical to SEQ ID NO: 136

SEQ ID NO: 139 - protein, 618 aa, Geobacillus sp. Y412MC61; identical to SEQ ID NO: 136

SEQ ID NO: 140 - protein, 617 aa, Geobacillus thermodenitrificans; identical to SEQ ID NO: 137

SEQ ID NO: 141 - protein, 680 aa, Geobacter bemidjiensis
MTSPFKHPISNALTSFNGNVAEPEQSVEQQSGAKVHHLPASIWKRKMGRAKSPLDVAIEGSRDFFFQEQLPKGYWWAELESNVTITAEYIMLFHFLGLVDPERQRKMSTYLLSKQTEEGFWTIYYGGPGDLSTTIEAYFALKLSGYPEDHPALAKARAFILEQGGVVKSRVFTKIFLALFGEFDWQGIPSMPVELNLLPDWAYINIYEFSSWARATIVPLSVVMHSRPVRRVPPSARVQELFVRQPTAADYSFAKNDGLFTWEKFFLGLDRVLKVYEKSPLRPFKKTALAKAEEWVLEHQEPTGDWGGIQPAMLNAILALNVLGYRNDHPAVEQGLRALANFCIETEDQLVLQSCVSPVWDTALALKALLDAGVPPDHPSLVKGAQWLLDKEVTRAGDWRVKSPNLEAGGWAFEFLNDWYPDVDDSGFVMIALKGIQVKDHKAMDAAIKRGINWCLGMQSKNGGWGAFDKDNTKHVLNKIPFADLEALIDPPTADLTGRMLELMGTFDYPVTFPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLSLLAAGEMHSATVVRGVQYLISTQNSDGTWDEQQYTGTGFPKYFMIKYHIYRNCFPLMALGTYRTLTRTQP

SEQ ID NO: 142 - protein, 684 aa, Geobacter lovleyi
MKSRKYPISHALTSFNHTTVAPVEAPAPISVKSPAKVHRLPSSIWKKMEGSAGNPLDKAVELTRDFFFREQLPDGYWWAELESNVTITAEYIMLFHFLGMVDKDKERKMANYLLRQQTEEGYWTVWHNGPGDLSTTIEAYFALKLAGYHADHIALRKARDFILANGGILKSRVFTKTFLAMFGEFSWLGVPSMPIELMLLPDWAYLNVYEFSSWARATIIPMSVLMANRPVYKLPPHARVQELYVRPPRPTDYTFTKEDGIFSLKNFFIGVDHLLKIYESSPIRPFKKRATEKVEQWILEHQEKTGDWGGIQPAMLNAILALHCLGYANDHPAVAKGLEALANFTIEDSDSLVLQSCISPVWDTALVLQAMQEASVPLDHPSLIKASQWLLDREVRIKGDWKIKSPDLEPGGWAFEFQNDWYPDVDDSTAVMIAIKDIKVKNTKARQDAIRRGIDWCLGMQSENGGWAAFDKDNTKHMLNKIPFADLEALIDPPTADLTGRMLELMGNFGYTKDHPQAVSALEFLKNEQEPEGPWFGRWGVNYIYGTWYVLIGLEAIGEDMNSPYIKKSVNWIKSRQNLDGGWGEVCDSYWDRTLMGCGPSTASQTSWALMALMAAGEVGCQAVERGIQYLLATQNSDGTWDEEAFTGTGFPKYFMIKYHIYRNCFPLTALGRYRRLTAGTHAQ

SEQ ID NO: 143 - protein, 730 aa, Geobacter metallireducens
MAKGILNKFAVIAGNKNAGLTAEEECTVVAPIKEVSGKAVHCRQAVKMAEEYLLALQNPEGYWVFELEADVTIPSEYIMLQRFLGREISPELRMRLENYLLDRQLPDGGWPLYAVDGFANISATVKAYLALKVLGHSPQAPHMIRARIMVLSLGGAARCNVFTRILLALFGQLPWHTPPAMPVEIVLLPQRFFFHLSKVSYWSRTVIVPMLLLYAKQPVCRLRPEEGIPELFNTPPDKLRNLDGFQSGRWRKNAFIIIDRLLKRFNRFIPSAIHRKAMAEAEHWTRSRMQGSGGIGAIFPAMAYAVMALRVLGCREDDPDYVRGMQAIDDLLQHRTPQEADSPRTGGPCIDSGTSAAFAFDPSPHAAADGRGNSSICQPCNSPIWDTCLSLSALMEAGMPASHPAAKQAVEWLLSQQIFSPGDWSLKAPDLEGGGWAFQFENTLYPDLDDTSKVIMSLLRAGALENGLYRDRVARGVNWVLGMQSSDGGWAAFDIDNNYHYLNDIPFADHGALLDPSTSDLTGRCIELLSMVGFDRTFPPIAQGIGFLRSKQEGSGAWFGRWGVNYIYGTWSVLSGLRQAGEDMQQPYIRRAVGWLTSCQNHDGGWGETCYSYDDPSLAGQGESTPSQTAWSLLGLMAAGDVHSLAVRRGVRYLLDHQNQWGTWEEKHFTGTGFPRVFYLRYHGYRHYFPLWALGVYSRLSSGQKTRQEERRHSSPGDLHLPWLERIGRR

SEQ ID NO: 144 - protein, 679 aa, Geobacter metallireducens
MKISKHPISHALTSFNETAKETKEEPQKKRGGKVHHLPASIWKKRDVETTSPLDQAIKRSQEFFLREQLPAGYWWAELESNVTITAEYVILFHFMGLVNRDKDRKMATYLLSKQTEEGCWCIWHGGPGDLSTTIEAYFALKLAGYPADHPAMQKARTFILGKGGILKARVFTKIFLALFGEFSWLGVPSMPIEMMLLPNGFTFNLYEFSSWSRATIIPLSIVMAERPVRKLPPWARVQELYVRPPRPMDYTFTKEDGILTWKNIFIGIDHILKVYEASPIRPGMKKAMAIAEQWVLDHQEPTGDWGGIQPAMLNSVLALHCLGYANDHPAVAKGLQALANFCIESDDEIVLQSCISPVWDTALALMAMVDSEVPTDHPALVKAAQWLLDREVRKVGDWKIKAPNLEPGGWAFEFQNDWYPDVDDSGIVMMAIKDVKVKDSKAKAEAIQRGIAWCIGMQSKNGGWGAFDKDNTKHILNKIPFADLEALIDPPTADLTGRMLELMGTFGYPKDHPAAVRALQFVKENQEPDGPWWGRWGVNYIYGTWSVLCGLKAYGEDMGQPYVRKAVEWLAAHQNPDGGWGECCESYCDQKLAGTGPSTASQTGWALLSMLAAGDVDHPAVARGIRYLIETQQPDGTWDEDQFTGTGFPKYFMIKYHIYRNCFPLMAMGRYRALKGHKG

SEQ ID NO: 145 - protein, 714 aa, Geobacter sp.
MNKHKGTFSVIEGGKTTQARGSETCAIMDAADLEKVTSVAASQLAGQQQDDGHWVFDLEADVTIPAEYVMLQRFIGREIDPEISERLAAYMQERQLPDGGWPLYAVDGNVNISASVKAYFALKLLGHDKNAPHMVRARQLILSLGGAAKCNVFTRITLATFGQIPWHTAPAMPIEIMLLPRWFFFHLNKVAYWSRTVIVPLLILYATQPICRLQYNEGITELFTTPPDMLVHLDKFRHHAWRKNVFIALDRVLKRTMHLVPGRIKQHALAEAERWTRARMQGDGGIGAIYPAMANAVMALKTLGCSDDDADYLRGLEAVDNLMVHRNLKTGTIPMDDDSGGIAIDNSSAAPELSPTYLTDTAGNTEFSFCQPCNSPIWDTCMSLSALCESGYAENNSGVTDRAIKWLFSQQIATPGDWSEKCPGLESGGWAFQYENSRYPDVDDTAKVLMSLFRAGALEKPEYREKIERAIRWVQGMQSTDGGWGAFDVDNDYFYLNDIPFADHGALLDPSTADLTGRCIEMMGMLGHGPDYPPIARGIAYLKKEQEPFGGWFGRWGVNYIYGTWSVLSGLHQAGENMDAPYVRKAVEWLISCQNSDGGWGETCASYDDPSLAGSGASTASQTSWALMALMAAGEWRHSAVRNGVRYLTESYCNGWNEKQFTGTGFPRVFYLRYHGYSLFFPVWALAVYSRYINGTATVQEKVREKQFRQCLMV

SEQ ID NO: 146 - protein, 680 aa, Geobacter sp.
MTSPFKHPISNALTSFNGNFAEPEQCVEQQTGAKVHHLPASIWKRKMGKAKSPLDVAIEGSRDFFFQEQLPKGYWWAELESNVTITAEYIMLFHFLGLVDRERQRKMSNYLLSKQTEEGFWPIYYGGPGDLSTTIEAYFALKLSGYPADHPALAKARAFILEQGGVVKSRVFTKIFLALFGEFEWQGVPSMPVELNLLPDWAYINIYEFSSWARATIVPLSVVMHSRPVRRVPPSARVQELFVRQPTAADYSFAKNDGIFTWENFFLGLDRVLKVYEKSPLRPFKNMALAKAEEWVLEHQEPTGDWGGIQPAMLNAVLALNVLGYQNDHPAVEQGLRALANFCIETEDQLVLQSCVSPVWDTALALKALLDAGVPPDHPSLVKGAQWLLDKEVTRPGDWRVKSPALEPGGWAFEFLNDWYPDVDDSGFVMIALKGIQVKDRKSMDAAIKRGINWCLGMQSKNGGWGAFDKDNTRHVLNKIPFADLEALIDPPTADLTGRMLELMGTFNYPITLPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLGLLAAGEMHSATVVRGVQYLISTQNSDGTWDEQQYTGTGFPKYFMIKYHIYRNCFPLMALGTYRTLTRTQP

SEQ ID NO: 147 - protein, 688 aa, Geobacter sp.
MSPCKHPISHALTSFNGETADSVPVQTPKTGAKIHHLPPSIWKKKEGELKSPLDIAIENSRDFFFREQLPDGYWWAELESNCTITAEYVMLYHFMDLVDRERERKMANYLLSKQTEEGFWTIYYGGPGDLSTTVEAYFALKLAGYPADHPAMVKARAFILDNGGIIKTRVFTKIFLALFGEFAWFGVPSMPIELILLPNWAYFNMYELSSWSRATIIPLSIVMTQRPVRKLPPASRVQELYVRPPSPIDYTFTKEDGIFTWKNFFIGVDHILKVYESNPIRPFKKKAMLAAENWVLEHQEATGDWGGIQPAMLNSVLALHCLGYANNHPAVAKGLEALENFCIESEDSLVLQSCISPVWDTALALKALVDSDVPNDHPALVKAAQWLLDKEIRKAGDWKVKSPELEPGGWAFEFLNDWYPDVDDSGFVMMALKDVAVKDRKSMDTAIKRGISWCLGMQSKNGGWGAFDKDNTKYLLNKIPFADLEALIDPPTVDLTGRMMELMGTFGYAKDYPPAVRALDFIKRNQEPDGSWWGRWGVNYIYGTWSVLCGLSAMGEDLNQPYIRKAINWLKSRQNIDGGWGETCESYHDSSLAGIGASTASQTGWALLALMAVGEENASAVARGVQYLLATQKSDGTWDEDLYTGTGFPKFFMIKYHIYRNCFPLTALGTYRRKTGGRAEMQVSEHNK

SEQ ID NO: 148 - protein, 680 aa, Geobacter sp. M18
MTSPFKHPISHALTSFNGIVTEPEQSVEQKAGAKVHQFPASLWKSKPGKAKSPLDIAIEGCRDFFFREQLPKGYWWAELESNVTITAEYIMLFNFLSLVDHERQRKMSNYLLSKQTEEGFWTIYYGGPGDLSTTVEAYFALKLTGYPADHPAMVKARAFILEKGGVIKSRVFTKIFLALFGEFDWLGVPSMPVELNLLPNWAYVNVYEFSSWARATIIPLSIVMLKRPVHKLPPSQRVQELFVRPPRAIDYTFTKEDGIFTWKNFFIGLDHMLKVYERSPVRPFKKRAMGKAEEWVLEHQEETGDWGGIQPAMLNAVLALSALGYDNGHPAVAHGLKALENFCIESDEQIVLQSCISPVWDTALALKALVDAGVPSDHPSLVKGAQWLLEREVRRPGDWRVKSPDLEPGGWAFEFLNDWYPDVDDSGFVMIALKGVEVKDRKAMNAAVKRGIDWCLGMQSKNGGWGAFDKDNTRHILNKIPFADLEALIDPPTADLTGRMLELMGTFGYAKTYPAAQRALKFLKENQEPEGPWWGRWGVNYLYGTWSVLCGLAAIGEDLEQPYIKKAVNWIKSRQNMDGGWGETCESYHDPTLAGMGESTASQTGWALLGLMAAGEVHSATVVRGVQYLISTQSQDGTWDETQYTGTGFPKYFMIKYHIYRNCFPLMALGTYRTLTGGTA

SEQ ID NO: 149 - protein, 680 aa, Geobacter sp. M21; identical to SEQ ID NO: 146

SEQ ID NO: 150 - protein, 730 aa, Geobacter sulfurreducens
MAKGILNKFAVIAGTKKAGPPAGEERTVIAPIKEISGKAVHCSQAVKKAEEYLLALQNPEGYWVFELEADVTIPSEYIMLQRFLGREISPELGKRLENYLLDRQLPDGGWPLYAEDGFANISATVKAYLALKVLGHSPQAPHMIRARLMVLSLGGAARCNVFTRILLALFGQIPWHTPPAMPVEIVLLPQWFFFHLSKVSYWSRTVIVPLLLLYAKQPVCRLRPEEGIPELFSTPPDKLRHLDGFQPGYWRKNAFIIFDRLLKRFNRFIPSALHRKAIAEAEQWTRSHMQGSGGIGAIFPAMAYAVMALRVLGCGEGDPDYIRGLQAIDDLLQHRTPQEADPPRTDGTCIDSGMSAAFALTPSAHAAADGTGSSSICQPCNSPIWDTCLSLSALMEAGMPASHPAATQAVEWLLSQQILSPGDWSLKVPDLEGGGWAFQFENTLYPDLDDTSKVIMSLLRAGALENERYRDRIARGVNWVLGMQSSDGGWAAFDIDNNYHYLNDIPFADHGALLDPSTSDLTGRCIELLSMVGFDRTFPPIARGIGFLRSEQEENGAWFGRWGVNYIYGTWSVLSGLRQAGEDMQQPYIRKAVGWLASCQNHDGGWGETCYSYDDPSLAGKGASTPSQTAWSLLGLMAAGEVNSLAVRRGVRYLLDHQNQWGTWEEKHFTGTGFPRVFYLRYHGYRHFFPLWALGVYSRLSSGQKACQDERRHASPGDLHLPWLERIKKR

SEQ ID NO: 151 - protein, 679 aa, Geobacter sulfurreducens
MKISKNPISHALTSFNDAARETADNSAARKSGKIHHLPATIWKKKESTVSSPLDIAIERTQEFFFREQLPAGYWWAELESNATITAEYIMLFHFMGLVNREKERKMANYLLRQQTTEGYWTIWHGGPGDLSTTIEAYFALKLAGYPADHPSMSKARAFILEHGGILKARVFTKIFLALFGEFSWLGVPSMPIEMMLLPAGFTFNMYEFSSWSRATIIPLSIVMAERPVRKLPPWARVQELYVRPPRPTDYTFTKEDGILTWKNIFIGIDHVLKVYEASPIRPGRKKAMAIAEKWVLEHQEPTGDWGGIQPAMLNSVLALHVLGYANDHPAVAKGLQALANFCIEGEDELVLQSCVSPVWDTALGLMAMVDSGVPTDHPSLSKAAQWLLDREVRRPGDWKIKCPDLEPGGWAFEFMNDWYPDVDDSGIVMMAIKNVKVKDQRAKEDTITRGIAWCLGMQSKNGGWGAFDKDNTKHILNKIPFADLEALIDPPTADLTGRMLELMGTYGYPKDHPAAVRALKFIRETQEPDGPWWGRWGVNYIYGTWSVMSGLAAFGEDMSQPWIRKAVDWLVEHQNEDGGWGECCESYADPRLAGVGPSTASQTGWALLTLLAAGEVASSSVVRGVQYLLDTQKPDGTWDEDAFTGTGFPKFFMIKYHIYRNCFPLMALGRYRTLAGKGL

SEQ ID NO: 152 - protein, 679 aa, Geobacter uraniireducens
MNSCKHPISHALTSFNGETADAAKKQPVKPGAKIHHLPASIWKKKEGESKSPLDIAIENSRDFFFREQLPDGYWWAELESNCTITAEYLMLYHFMGIVDQERERKMATYLLSKQTAEGFWTIYFGGPGDLSTTVEAYFALKLAGYPADHPAMAKARAFILDNGGIIKCRVFTKIFLALFGEFAWFGVPSMPIELILLPNWAYFNMYELSSWSRATIIPLSIVMTERPVRKLPPSSRVQELYVRPPRPIDYTFSKEDGIITWKNFFIGVDHILKVYESNPIRPFKKRALATAENWVLDHQESTGDWGGIQPAMLNSVLALHCLGYANDHPAVAKGLEALANFCIETEDSLVLQSCISPIWDTALALKALVDSDVPTDHPALVKAAQWLLDKEVRKPGDWKIKCPELESGGWAFEFLNDWYPDVDDSGFVMMALKDVAVKDRKSMDGAIKRGINWCLGMQSKNGGWGAFDKDNTKYLLNKIPFADLEALIDPPTADLTGRMLELMGTFGYSKDYPAAVRALEFIKKNQEPEGSWWGRWGVNYIYGTWSVLGGLAAIGEDLNQPYIRKAVNWLKSRQNMDGGWGETCESYHDTSLAGIGESTPSQTGWALLSLMSAGEANSSTVARGIQYLIANQKSDGTWDEEQYTGTGFPKFFMIKYHIYRNCFPLTALGTYRKLTGGMA

SEQ ID NO: 153 - protein, 637 aa, Gloeobacter violaceus
MQVQPRIEKKHLDSAIEASQAYLLARQYSPGYWWAELESNVSMTAEVVLLHKIWRTDTGRPLAKATAHLLAEQRAHGGWELFYGDGGDLNTSIEAYMALKLLGLTADHPALARARAFILAKGGISRARIFTKIHLALIGCYDWRGVPSIPPWVMLLPEAFPVNIYEMSSWARGSTVPLLIVFDRKPVFAVEPAITLDELFVEGRAQARFDLPRSSSDWWANLFVDLDWGFKLAESLGAVPLREEGLKAAERWVLERQEATGDWGGIIPAMLNSLLALRCLDYDPHDPVVERGMAAVDRFAIETESTYRLQPCVSPVWDTALTMRALVDSGLPPDHPALAAAGTWLLKKQILDYGDWAVKNRTGPPGGWAFEFDNRFYPDVDDTAVVVMALDAVRLADETAKGQAIARAVCWVASMQCRGGGWAAFDIDNDAHWLNSLPYADLKAMIDPNTADVTARVLEMYGRCRLIPAAAGAQRALDYLRRTQEPEGCWFGRWGVNYLYGTSGVLSALAAFAPAERTAIERAAAWLRGCQNTDGGWGETCGSYVDRTLMGQGPSTASQTAWALLGLIDASRVARFSDSSALERGLAYLVETQKADGSWDEPYFTGTGFPGHFYLKYHLYQQHFPLSALGRYRRLLS

SEQ ID NO: 154 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPEGIRPEDTKKKLAAAAEWLRERQILNVKGDWAINCPDVPPGGWAFQYNNDYYPDVDDTAVVGMLLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 155 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPKGIRPEDTKKKLAAAAEWLRERQILNGEGRLGDQLPRRAPRRLGLPVQQRLLPRRGRHGSGRHVLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 156 - protein, 664 aa, Gluconobacter oxydans
MLIYSDILEKEDRVSETLSRQSVEPDEINHAIEGAQAALGGKQKSDGHWVYELEADATIPAEYVLLEHYLDRIDPEKQAKIGVYLRRIQGHHGGWPLYHDGGFDLSATVKAYFALKAIGDDINAPHMRIAREAILDHGGAARTNVFTRIQLALFGEVPWDATPVMPVELMLLPRKAFFSVWNMSYWSRAVIAPLLVLNALRPKAINPRGIHVQELFVKPPSEVKDWIRGPYRSVWGRFFKHLDSALRPVLPLIPRSVHKKALKAASDFIEPRLSRGGLGAIYPAMANVVMMYRAQGVPDSDPRAKTAWDAIQDLLVDHGDEIYCQPCVSPVWDTGLSGLAMIEAASGPAGTKTKETLAALKKSAEWLREHQILDVKGDWAINAPDLRPGGWAFQYENDYYPDVDDTAVVAMLLHRVDPENSREAISRAREWIIGMQSTNGGWGAFDIDNDHELLNHIPFSDHGALLDPPTADVSARCISFLAQLGDPDDRPVILKAIEYLRSEQEPEGCWFGRWGTNYIYGTWSVLCALNIAGVPHDDPMVLRAVNWLESVQRPDGGWGEDCATYEGGTAGTYKKSLPSQTAWAVLALMAVGRRESEAVKRGVAYLVSQQNEKGEWQEEAYNAVGFPKVFYLRYHGYKQFFPLTALARYRNLGVSNSGKVEYGF

SEQ ID NO: 157 - protein, 651 aa, Granulibacter bethesdensis
MPKDIPADLASEAISGDMLEQAVLRASMALHRKQQTDGHWVFELEADATIPAEYVLLEHFLDRIDDDLERKIGVYLRRIQGDHGGWPLFHEGAFNLSASVKAYYALKAIGDDPDAPHMRRAREAILAAGGAERSNVFTRIQLALFGQIPWRGVPVMPAELMIAPKWFPINMWKVSYWSRTVIAPLLVLMDRKPKARNPRNVHVRELFLHDPDRIRDWIRGPFRSGWGHFFKYLDSVLRVVEPVALKPMRPRSIRLAVDFVRERLNGEDGLGAIYPAMANSVMMYDVLGYSPDHPEAAIAWESVRKLLVIKEDEAYCQPCLSPIWDTGLSGHAMAEAEGAVSPGVAAACDWLRNRQITDVVGDWAEIRPGVQPGGWAFQYNNAHYPDVDDTAVVAMLLHRQGDPAHEESIRKAREWIIGLQCRDGGWGAFDADNDKDYLNHIPFADHGALLDPPTADVTARCISFLAQLGNPEDKPVIDRAMAWLRKEQEADGSWFGRWGTNYIYGTWSVLCAMNVAGMPHDDPAIRRAVNFLVATQREDGGWGEDEETYDPASGAQPGRYKESTPSQTAWALIGLMAAGEAEHEATRRGIAYLQATQKPDGEWDEAAYTAVGFPRVFYLKYHGYRQFFPLMALSRYKNLRSSNMKKVSFGF

SEQ ID NO: 158 - protein, 665 aa, Hyphomicrobium denitrificans
MTTNAAATSARSGEDAIRQVSGQQLETAIASARNSLLALQRPDGHFVFELEADATIPAEYVLMRHYLAEPVDAVLEEKIARYLRRIQSDDGGWPLFRDGASNISASVKAYYALKMIGDAPNAPHMQKARAWILAQGGASHSNVFTRNLLALFGAIPWSGVPVMPVEIMLLPKWFPFHIDKISYWARTVLIPLTVLNALKPVARNPKGVGIAELFVTPPDQVRNWPKGPHQKFPWSQVFGGIDRVLRLFEPAFPKSLRKKSIDKAVAFATERLNGEDGLGGIFPAMVNALLVYDALGYPHDHPDYVTARGSIEKLLVIKDDEAYCQPCLSPVWDTALAVHALMESGVAQADQNVDRALAWLKPLQVLDTVGDWAASRPGVRPGGWAFQYANAYYPDVDDTAVVVMAMDRAAGGDAAKRDHYRESMARGREWVAGVQSKNGGWGAFDADNTYEYLNQIPFSDHGALLDPPTADVSARCVSMLAQLGERRETSPVLDKAMRYLESTQEKDGSWYGRWGMNYIYGTWSVLCALNAAGVAPSAPSMRKAADWLLSIQNSDGGWGEDGESYSLDYKGYEPAPSTASQTAWALMGLMAAGEVDHPAVQRGVAYLAAKQGSDGFWGEERFTATGFPRVFYLRYHGYSKFFPLWALARYRNLNAANSKSVLVGM

SEQ ID NO: 159 - protein, 694 aa, Leptospirillum ferrodiazotrophum
MSGQSNFTGGKKMTPAEGSSSPAPALLEKAAPSIELDERSDPLSRTLARAVSWLVAAQDGAGHWVAPLEADATIPSEYVFLHEVLGRPLDPVRRDKIVRAILSVQGKEGAWPLFHDGDPDISATVKAYQALKLCGFDPSHPALVRAREWVLSQGGAGKVNVFTRIALAIFGQYSWTKIPALPAEMVLLPSWFPFSIYSVSYWSRTVIVPLLFIYHHKPLVRLSPERGISELFDPARPDGESFAPSPDFFSLRNLFLLLDKVLQVWNRHPPGFLRKKALSFAMEWMVPRLKGEGGLGAIYPAMANSAVALSLEGYELDHPLMQRVLASIDDLLIEGEKEVLVQPCVSPVWDTALAMGALIEAGISPDSPTVDRAMEWFCAREVRTRGDWAIRAPDCEPGGWAFQFENDYYPDVDDTAMVLMGMAKILPARPDLAARMEGVFRRATLWVMAMQGTDGGWGAFDRDNDLLFLNHIPFADHGALLDPSTADLTGRVLELLGALGYGPDFPPAARAIRYLRREQEEDGSWFGRWGVNYIYGTWSVVAGLKSIGVPMSEPWVMRSMEFLLARQNPDGGWGEDCLSYASRDFAGRGASTPSQTAWALIALLHGGHAGHMAVRQGVDYLIQQMTPEGTWNEELFTGTGFPRVFYLRYHMYRHYFPLWALALYRNMTERGRALGHERVDFWKTAPYAPIARSV

SEQ ID NO: 160 - protein, 683 aa, Leptospirillum rubarum
MKGKEPTREELLSFSSGIQMDSSAENTTPVSTEELQEKVRLAAESLISRQVEEGYWVEPLEADVTITSEYILLQYLLGRERDEFFRRAAPFILESQGEDGGWPLYHGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYAMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQKAMQFLFSRQNPDGGWGESCYSYFRKDTAGEGVSTSSQTAWALIALIHGGHVRHPAVSKGIDFLLSRQQADGKWLEQEYTGTGFPKVFYLRYNMYRDYFSLWALSLYRNVLLDGQSRVERLARRWKGNPYPVRSRFLA

SEQ ID NO: 161 - protein, 683 aa, Leptospirillum sp.
MEGKDPTREELLSFTSGIQMDSRVGNTNPVSTEELQEKVRLAAESLISRQGEEGYWVEPLEADITITSEYVLLQYLLGRERDEFFRRAAPFILESQGEDGGWPLYNGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYEMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQRAMQFLFSRQNPDGGWGESCYSYFRKDTAGEGVSTASQTAWALIALIHGGHVRHPAVSKGIDFLLSRQQADGKWLEQEYTGTGFPKVFYLRYNMYRDYFSLWALSLYRNVLLDGQSRVERLSRRWKGTPYPVRSRFLA

SEQ ID NO: 162 - protein, 683 aa, Magnaporthe grisea
MSPFLQASDDNNPLFKESCQALDHATEFARDTLVNKEHWCGWVLSNVTVTAEWIFLQYILGLEMSNEDRRGFLKHFTSSQRPDGSWSLATQTTTGGELSCTIEAYLALKILGVSPEEDYMVRARDYVRSHGGAEKMRMLSRFHLAMFGLIPWAAVPQMPPELIFMPSWSLVNIYKFSSWARCNIVGLCMLRVHEPLYALPNGKQLDNDYLDELWLDPYHKAIPYTVPYLQLMQTSPLGVLFQLGDLFLWLLSFLGFWFLRRWAVSSSIQWTLDHQEPSGDWGGIYPPMHHNILALMLEGWSQDDPVIQRGIGACQRFLAEDPAHGKWMQPSVSPVWDTFLMIRAVADAKTTDDADKLLVKPVDWVLAQQIDDDHIGDWRIYRPDIPAGGFAFEYFNKWYPDVDDTAVGVVALMRHDPSLVNDDRILKAAAWTLGMQNRDFGWAAFDADNNAFYLHATPFSDMDSLTDSSTPDVTGHVLEMLGLMYRLERQGRVKSPEMLAFLSQSHGACDRGLGYLLGSQEAFGGWYGRWGVNYIFGTSAALCALAYFADRKGVRGKMAAGADWLRSRQNPDGGWGELLESYDNKALAGRGRSTPSQTAWALQGLLELEDPRGEVVEAGVNWLLRHQVTSPSRNSGRVSATWPEDDYTATGFPGHFYLKYELYCHYFPMMALARYRSCIQDGA

SEQ ID NO: 163 - protein, 667 aa, Magnetospirillum magnetotacticum
MREAAVSKVETLQRPKTRDVSLDDVERGVQSAARALTDMTQADGHICFELEADATIPSEYILFHHFRGTEPRAGLEAKIGNYLRRTQSKVHGGWALVHDGPFDMSASVKAYFALKMIGDDIEAPHMRAVRKAILQRGGAANANVFTRILLALYGEVPWTAVPVMPVEVMHLPKWFPFHLDKVSYWARCTMVPLFVIQAKKPRAKNPRGVGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLEVGGTQAEANARAGLDWLKPLQILDIKGDWAETKPNVRPGGWAFQYANPHYPDLDDTAVVVMAMDRAQRQHGLVSGMPDYSTSIARAREWVEGLQSADGGWAAFDADNNHHYLNHIPFSDHGALLDPPTADVTARVVSMLAQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGADGLWNEERYTATGFPRVFYLRYHGYPKFFPLWAMARFRNLKRGNSRQVQFGM

SEQ ID NO: 164 - protein, 691 aa, Methylacidiphilum infernorum
MHSGRVFLEKENREENRATFHSSPLILVEESLNLPKKVEETIKKAQRYLLSIQKEDGHWVGELFVDVTLACDCIHLMHWRGKIDYKKQLRLVKHIVDRQLPDGGWNIYPGGPSEVNATVKAYFALKLAGFSPDDPLMAKARSTILRLGGIPKCMTYTKLGLALLGVYPWDRLPVIPPEIILFPNWFPFNIYEISAWSRAMLVPLSVIHHFKPTRNLPEKYQLHELFPYGTEHGKFSWLKKGARYLSKQGLFLACDKFLQYWDKTSLKPFRKMALKKAEKWLLERISAGSDGLGAIFPAMHYAIMALIAMGYTEDNPILKKAIADFEGLEVDDKKNDDLRIQPCLSPVWDTAVGLVALAESGVARNAKELKRAAYWLLDREIKIKGDWHVRNPHPEPSGWAFEYNNVYYPDVDDTLMVLLALRLIDIEDKIRKEEVMQRALRWVISFQCKNGGWAAFDKDVYKKWLEDIPFADHNAILDPPCSDITARALELFGKMGIKKTERFVQKAIAYLKETQENDGSWMGRWGVNYIYGTWQALRGLQAIGENMNQEWILRARDWLESCQNEDGGWGETPASYDNPQLKGKGPSTASQTAWAVSGIMACGDIFRPSVSRGIKYLCDRQLSDGSWAEEFLTGTGFPGVFYLKYDMYRNAWPLLVIGEYHRQYLKAKEQVSYWVDGTIGRKVKKERLPEI

SEQ ID NO: 165 - protein, 667 aa, Methylobacterium chloromethanicum
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWAAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNTAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 166 - protein, 645 aa, Methylobacterium chloromethanicum
MNTEPRFSAPETLRAIAGAGRALGRHQRRDGHWVFELEADATIPAEYVLLEHYMDRITPERQARIGAYLRRIQGEHGGWPMFHAGEFNISASVKAYCALKAIGDDPQAPHMVRARQAILGHGGAERANVFTRIQLALFGAIPWRGVPVMPVEIMHLPKWFFFNIWAMSYWARTCVVPLLVLQARKPRARNPRQVSFDEIFRTEPDEVRDWIRGPYRSRWGVVFKHIDTVLRWTEPLFSKVARESAIFKAVDFVEERLNGEDGLGAIYPAMAYALMMYDVLGYPEDDPRCVTIWKAIDKLLIETDEEVYCQPCVSPVWDTSLSGHAMIEAARTGGIEAQAELDAACDWLVARQVKDVRGDWAETRPDAEPGGWAFQYRNDHYPDVDDTAVVAMLLHRNGRPEHAEAIEKARRWVVGVQSRNGGWGAFDADNDREFLNHIPFSDHGALLDPPTADVTGRCISFLSQLGHEEDRPVIERALAYLRAEQERDGSWYGRWGTNYVYGTWTVLCGLNAAGIPHDDPMVRRAVDWLVSIQRADGGWGEDERSYDVGHYVENAESLPSQTAWAMLGLMSVGQADHPAVLRGAAYLQRTQGPDGEWQERAYNAVGFPRVFYLKYHGYRLFFPLFALSRLHNLQRGNSREVSFGF

SEQ ID NO: 167 - protein, 667 aa, Methylobacterium extorquens
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWVAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 168 - protein, 663 aa, Methylobacterium nodulans
MGKVETLHRMSTQDITLDDVERRVSLASKALMRLAGPDGHWCFELEADATIPSEYILYHHFRGSIPSAELEGKIANYLRRTQSAQHDGWSLVHDGPFDMSATVKAYFALKMIGDSIEAPHMRRAREAILRRGGAAHANVFTRTLLALYGEVPWSAVPVMPVEVMLLPRWFPFHLDKVSYWARTVMVPLFVLQAKKPRARNPRGIGIQELFVEPPERVKRWPAGPQESSPWRPVFAAIDKVLQKVEGSFPAGSRARAIDKAVAFVSERLNGEDGLGAIFPAMVNAVLMYEALGYPEDHPLVATARSSVEKLVTVKEHEAYVQPCLSPVWDTALSAHALMEAGGVEAERHAKRALDWLKPLQVLDIKGDWAASKPNVRPGGWAFQYANPHYPDLDDTAVVVMAMDRAQVRRSPGPDAADYGQSIARAREWVEGLQSRDGGWAAFDADNTYHYLNYIPFSDHGALLDPPTADVTARCVSMLAQLGETRESCPPLDRGVAYLLADQEADGSWYGRWGMNYIYGTWSVLCALNAAGVDPASEPVRRAVNWLTTIQNPDGGWGEDAASYKLEYRGYERAPSTASQTAWALLGLMAAGEADSPAVARGINYLTRSQGADGLWTEDRYTATGFPRVFYLRYHGYAKFFPLWALARYRNLQQSNSRRVAVGM

SEQ ID NO: 169 - protein, 667 aa, Methylobacterium populi
MREAAVSKVETLQRPKTRDVSLDDVERGVQNAARALTEMTQTDGHICFELEADATIPSEYILFHQFRGTVPRDGLEAKIGNYLRRTQSKVHGGWALVHDGPFDMSATVKAYFALKMIGDDIEAPHMRAARKAILQRGGAANANVFTRILLALYGEVPWAAVPVMPVEVMHLPKWFPFHLDKVSYWARCTMVPLFVIQAKKPRAKNPRGIGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLETGGAAAEANARAGLDWLKPLQILDIKGDWAETKPNVRPGGWAFQYANPHYPDLDDTAVVVMAMDRAQRQHGLVSGMPDYSASIARAREWVEGLQSADGGWAAFDADNNHHYLNHIPFSDHGALLDPPTADVTARVVSMLSQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGQDGLWNEERYTATGFPRVFYLRYHGYPKFFPLWAMARFRNLKKGNSRQVQFGM

SEQ ID NO: 170 - protein, 665 aa, Methylobacterium radiotolerans
MREAVSKVEALQRSKTQGISLEDVERGVAQATRALTALAHDDGHICFELEADATIPSEYILFHHFRGTQVPGDLEAKIGNYLRRTQGRHGGWALVHEGPFDMSCTVKAYFALKMIGDDIEAPHMRRAREGILSRGGAANANVFTRFMLALYGEVPWRAVPVMPVEVMFLPKWFPFHLDKISYWARTTVVPLFVLQATKPRARNPRGISVQELFVTPPESVRSWPGSPHATWPWTPIFGFIDRVLQRVENHLPRKSRQRAMEMARAWVSERLNGEDGLGAIFPAMVNSVLMYEVMGYRPDHPQVRVACDAIEKLVVEKADEAYVQPCVSPVWDTALASHALLEAGGPEAEAQARAGLDWLKPRQVLDIVGDWAARKPKVRPGGWAFQYANAHYPDLDDTAVVVMAMDRAMHQHGLVAGMPDYKASIARAREWVEGLQSEDGGWAAFDADNNHMYLNHIPFSDHGALLDPPTADVTARVVGMLSQLGETRETSRALDRGVNYLLNDQEEDGSWYGRWGMNFIYGTWSVLCALNAAGVDPADPRIQKAVSWLIRIQNPDGGWGEDASSYKIDPAFEPGSSTASQTAWALLALMAAGAVDDPAVTRGINFLTRTQGADGFWKEERYTATGFPRVFYLRYHGYPKFFPLWAMARFRNLKRGNSRRVQFGM

SEQ ID NO: 171 - protein, 663 aa, Methylobacterium sp.
MGKVETLHRTSTQDITLDDVERRVTLASKALMRLANADGHWCFELEADATIPSEYILYHHFRGSIPTAELEGKIAAYLRRTQSAQHDGWALIHDGPFDMSATVKAYFALKMVGDPIDAPHMRRARDAILRRGGAAHANVFTRIMLALYGEVPWTAVPVMPVEVMLLPRWFPFHLDKVSYWARTVMVPLFVLQAKKPRARNPRGIGIRELFVEAPERVKRWPAGPQESSPWRPVFAAIDKVLQKVEGFFPAGSRARAIDKAVAFVSERLNGEDGLGAIFPAMVNTVLMFEALGYPDDHPFAVTARSSVEKLVTVKEHEAYVQPCLSPVWDTALAAHALMEAGGTEAERHAKRAMDWLKPLQVLDIKGDWAASKPDVRPGGWAFQYANPHYPDLDDTAVVVMAMDRVQSRRSPGPDAADYGLSIARAREWVEGLQSRDGGWAAFDADNTYHYLNYIPFSDHGALLDPPTADVTARCVSMLSQLGETRETCPPLDRGVAYLLADQEADGSWYGRWGMNYIYGTWSVLCALNAAGIDPACEPVRRAVTWLTAIQNPDGGWGEDASSYKLEYRGYERAPSTASQTAWALLALMAAGEADNPAVARGINYLTRTQGADGLWAEDRYTATGFPRVFYLRYHGYAKFFPLWALARYRNLQRGNSLKVAVGM

SEQ ID NO: 172 - protein, 672 aa, Methylocella silvestris
MDDRVGAATFEAQPRAGFGSVEAAISRAREALLAVQKPDGHFVFELEADVSIPAEYILFRHFLGDPAKTEIERKIGVYLRRRQTAAGGWPLFAEGVFNVSSSVKAYFALKIIGDDPNAPHMAKARNAILAHGGAAQSNVFTRSLLALYGEVPWRAVPAMPVEIMHLPRWFPFHLSKVSYWGRTVIAPLIVVHALKPRAKNPRKISVSELFVAPAETVSRWPGAPHKSFPWTTIFGAIDRVLHKTEPLLPARSHQTAIDKAVAFVTARLNGEDGLGAIYPAMAYSAMMFFALGAPLSDPRIVQIRKAIDRLLVIKDGEAYCQPCVSPVWDTALASHALMESAGQRPEARTAPAAAAVFEALDWLKPLQVLDVKGDWATQNPDVRPGGWAFQYANPHYPDLDDTAVVVLAMDRAVKTSPLIAGEEETAYVEAISRAREWILGLQSANGGFGAFDADNDRDYLNYIPFADHGALLDPPTADVTARCVSMLGQLGERPETSPALARAIDYLLSEQEEEGSWFGRWGMNYIYGTWSVLSAFNAVERPADCAATRKAAAWLKRIQNPDGGWGEDGESYALGYKGYNPAPSTASQTAWALLALMAAGEVDAPEVALGLDYLVSTQADDGFWDEARFTATGFPRVFYLRYHGYAKFFPLWAMARYRNLKSGNRLKTQFGM

SEQ ID NO: 173 - protein, 654 aa, Methylococcus capsulatus
  misc_feature (591)..(591): Xaa can be any naturally occurring amino acid
MLREATAISNLEPPLTASYVESPLDAAIRQAKDRLLSLQHLEGYWVFELEADCTIPAEYILMMHFMDEIDAALQAKIANYLRHHQSADGSYPLFRGGAGDISCTVKVYYALKLAGDSIDAPHMKKAREWILAQGGAARSNVFTRIMLAMFEQIPWRGIPFTPVEIMLLPKWFPFHLDKVSYWSRTVMVPLFILCSHKVTARNPSRIHVRELFTVEPQKERHYFDHVKTPLGKAILALERFGRMLEPLIPKAVRKKATQKAFDWFTARLNGVDGLGAIFPAMVNAYEALDFLGVPPDDERRRLARESIDRLLVFQGDSVYCQPCVSPIWDTALTSLTLQEVARHTADLRLDAALSKGLKWLASKQIDKDAPGDWRVNRAGLEGGGWAFQFGNDYYPDVDDSAVVAHALLGSEDPSFDDNLRRAANWIAGMQSRNGGFGAFDADNTYYYLNSIPFADHGALLDPPTADVSARCAMFLARWVNRQPELRPVLERTIDYLRREQEADGSWFGRWGTNYIYGPGAVLLAYEGRRVPNDDPSVRRAVAWLKSIQREDGGWGEDNFSYHDPSYRGRFHTSTAFQTGFALIALMAAGEXGSPEVQAGVDYLLRQQRPDGFWNDECFTAPGFPRVFYLKYHGYDKFFPLWALARYRNERYALA

SEQ ID NO: 174 - protein, 635 aa, Microcystis aeruginosa
MQIQDKITEIAAKTAKAIELSQNYLLSTQYSEGYWWAELESNVTITSEAILLHKIWKTDKKRPLDKAATYLRQQQCPNGAWELFYGDGGDLSTTVEAYMGLRLLGIPANDPALEKAREFILAKGGISKTRIFTKMHLALIGCYDWQGVPSIPAWIMLLPENFPFTIYEMSSWARGSTVPLLIVFDKKPVYKMGFNLDELYTEGVNNVKYELPKNNNWSDVFLWLDGLFKWAEKTDLVPFRQESLKAAEKWVIERQEDTGDWGGIIPAMLNSLLALKALDYDVYDPIVARGLKAVDNFAIETDNTYCVQPCVSPVWDTAWVIRSLIESGLNPAHPAMIKAGQWLIDQQILDYGDWAIKNKIGTPGGWAFEFDNRWYPDLDDSAVVVMALELIKMPDENIKTSVMKRAVNWMATMQCKAGGWGAFDIDNDQNWLNSLPYADLKAMIDPNTADVTARVLEMLGTCDVKMGENRVKKALDYLEKEQEADGSWFGRWGVNYIYGTSGALSALAFLEPNQYRQQLQKGANWLSSCQNVDGGWGETCFSYNNPKFKGQGNSTASQTAWALIGLLAVGKVTGNYQREVIEKGVNYLLVTQKENGTWDEDYFTGTGFPCHFYLKYHFYQQYFPLLALGRYRALI

SEQ ID NO: 175 - protein, 695 aa, Neosartorya fischeri
MLQTEAITTEGLRFRSLAPDDPLLPRVKQALKLSGQHSREEMHSDGHWCGEVKTNATTSAEHVLLCQALDINLDADREAFISWFRCTQGADGGWSTAPDQAGDISVTVEAYLALKILGLSEDDAAMRSARDFAIAAGGVARVRIFTRIYLAMFGLFPWAAVPELPPELILLPSRVPVSIYHWSAWARATVVPLLIISHHRPIYALPGGKATCSDYLDELWCDPRNKMVPYNHDKPTAWRSDPFALIFTLADSILHRLDGLRSFNPLRRFALRKCVDWILEHQEDMGDIGDIMPPLHGAMLALRLEGYPLHSDPIHRGLEAIERFAYRDQQGKRIQTTVSAFWDTSLMLVALGDAGMASSPWLTRSLGWLQQHQRLGNYGDWKVNNPGLKAGGFSFGYFNTWYPDVDDTASAVLAIIRQDERLVCSASVLDALNWLLGMQNTDGGWGAFDRDNNKLFLNKIPFSDMEAFCDPSTPDVTGHVLEAFGIFLAVSARQQSPTKADVLTDRIVSASRRAICYLSDTHVSSGGWYGRWGCNYIYGTSAVLCALAYFGSKSDTLSGVRSVKDAVNQAIRWLETVQNQDGGWGETVNSYKDPSRAGSGPSTASQTAWAIMALLPYLPPSTEVIQRGVEYLLRTQTKTASQGATWHEKAYTGTGFPKYFYMGYSFYCHYFPMMALGRYAYPCPEWHENWRPKKE

SEQ ID NO: 176 - protein, 654 aa, Nitrobacter hamburgensis
MNSVNATVAPIDDAALGGSIGAATRGLLDLKQPDGHFVFELEADATIPSEYVLLRHYLGEPVDAALEAKIAVYLRRIQGAHGGWPLVHDGPFDMSASVKAYFALKMIGDSIDAPHMARAREAILSRGGAANVNVFTRFLLSLFEVLTWRSAPVLPIEIMLLPMWSPFHINKISYWARTTMVPLMVLAALKPRARNPRGIGIRELFLQDPATVGTPKRAPHQSPAWFTLFNSLDWILRKIEPLFPKRLRARAIEKAIAFVEERLNGEDGLGAIFPPMVNTVMMYDALGFPPEHPPRAVARRGIDKLLVIGKDEAYCQPCVSPIWDTALTCHALLEAGGPEALSGAGKSLDWLLPKQELVLKGDWAVKRPDVRPGGWAFQYANAHYPDLDDTAVVVMAMDRVRRNDRSDKYNEAIARGREWIEGMQSRDGGFAAFDADNLEYYLNNIPFSDHAALLDPPTEDVTARCVSMLAQLGETVRSSPSMAAGVDYLRRTQLKEGSWYGRWGLNYIYGTWSVVCALNAAGVDHQDPAMRKAVDWLVSIQNADGGWGEDAVSYRLDYKGFEGAPTTASQTAWALLALMAAGEVENPAVARGMKYLIDTQTKKGLWDEQRFTATGFPRVFYLRYHGYSRFFPLWALARYRNLRSTNSKVVGVGM

SEQ ID NO: 177 - protein, 651 aa, Nitrobacter sp.
MNATVAQIGDAVLEDRIGSATRGLLNLKQSDGHFVFELEADATIPSEYILLRHYLGEPVDTVLEAKIAAYLRRIQGAHGGWPLVHDGPFDMSASVKAYFALKMIGDSVDAPHMARAREAILSRGGAANVNVFTRFLLSFFEVLTWRSVPVLPVEIMLLPMWSPFHLNKISYWARTTMVPLMVLAVLKPRARNPRDVGIRELFLQDPATVRTPKRAPHQSPAWFALFSSLDWILRRIEPLFPKRLRARAMEKAIAFVEERLNGEDGLGAIFPPMVNTVMMYDALGFPPEHPPRAVTRRGIDKLLVIGEDEAYCQPCVSPIWDTALSCHALLEAGAPEALNSAGKCLDWLLPKQELVLKGDWAAKRPDVRPGGWAFQYANGHYPDLDDTAVVVMAMDRVRRNGRGDKYDEAIERGREWIEGMQSRDGGFAAFDADNLEYYLNNIPFSDHAALLDPPTEDVTARCVSMLAQLGATVDGSSSMAAGVEYLRRTQLAEGSWYGRWGLNYIYGTWSVLCALNAAGVDHQDPAIRKAVDWLLSIQNEDGGWGEDAVSYRLDYKGFEGAPTTASQTAWALLALMAAGEVENPAVTRGIKYLIDTQTKKGLWDEQRYTATGFPRVFYLRYHGYSKFFPLWALARYRNLRSTNSKVVGVGM

SEQ ID NO: 178 - protein, 654 aa, Nitrobacter winogradskyi
MNSINATAAPIDDNVLGDRIGAATRGLLSLKQSDGHFVFELEADATIPSEYILMRHYLGEPVDTVLEAKIAAYLRRIQGAHGGWPLVHDGPFDMSASVKAYFALKMAGDSIDAPHMARAREAILSRGGAANVNVFTRFLLSFFGELTWRSVPVLPVEIMLLPMWSPFHLNKVSYWARTTMVPLMVLAALKPRARNPRGIGIRELFLEDPATVGTPKRAPHQSPGWFALFTGFDRVLRLIEPLSPKWLRARAMKKAIAFVEERLNGEDGLGAIFPPMVNTVMMYDALGFPPEHPPRAVTRRGIDKLLVVGENEAYCQPCVSPIWDTALSCHALLEAGGPEAVNSAGKCLDWLLLKQELVLKGDWAVKRPDVRPGGWAFQYANGHYPDLDDTAVVVMAMDRVRRNGPNGRYDEAIARGREWIEGMQSRDGGFAAFDADNLEYYLNNIPFSDHAALLDPPTEDVTARCVSMLAQLGETVDSSSSMAAGVEYLRRTQLAEGSWYGRWGLNYIYGTWSVLCALNVAGVDHQDPVIRRAVNWLVSIQNADGGWGEDAVSYRLDYKGFEGAPTTASQTAWALLALMAAGEVENPAVARGIKYLIDTQTKKGLWDEQRYTATGFPRVFYLRYHGYSKFFPLWALARYRNLRSTNSKAVGVGM

SEQ ID NO: 179 - protein, 652 aa, Nitrococcus mobilis
MEQQPELISGGVGGVAYPWDLGSQAIEEAILAARAALLAHLHPDGYWCFELEADCTIPAEYIMMMHYTGELEAALELKLARYIRECQLQEGGWPLYYGGAMDISCSVKAYFALKLAGDDPEAAHMRRARKAVLERGGAVNANVFTHIALALFGEIPWRGVPFMPPEILLLPRWFPFHLSKVSYWSRTVMVPLFILAAHKPRARNPRAIHISELFVTDPQLETGYFKARSRLNRLFITLDALGRRIEPFIPRAVRAKALRRAAEWFITRLNGEHGLGAIFPAMVNSYEALELLGYAADHPLRQQVRKGLRDLVVEQADRAYCQPCLSPIWDTALACLALQEADRGSSSAQVRHALDWLQARQLLDTPGDWSEQHPSLPGGGWPFQFRNDHYPDLDDTAIVAWAMQRASDPERYGAAIRRATVWLLGMQSANGGFAAFDSDNTRYYLNEIPFADHGALLDPPTSDVTARVVALLGSLDGEVHDRSALNRAVAFLHREQEAEGCWYGRWGTNYIYGTWSVLTALEQLGYDFNAPWVRKAVIWLKSVQRDDGGWGESNDTYLDHRPQDRQADESTPFQTAWAVLALIAAGECRSPEVWRGVEYLLRHQRPDGLWYCPWFTAPGFPRVFYLKYHGYDAYFPLMALARYRNCVLDNDA

SEQ ID NO: 180 - protein, 659 aa, Nitrosococcus oceani
MTRALRQAPESAGAIGIAAASPATETSGQDTHPREISGAITAARDALLKLQQADGHWCFMLEADCTIPAEYILWTHFTGELEPEIERKLAARLRAKQASHGGWPLYEGGDLDISCSVKVYYALKLVGDDPNAPHMRRAREAILAQGGGARANVFTRLALAMFSQIPWRGVPFIPVEIMLLPRWFPFHLSKVSYWSRTVMVPLAILYSLKAQAQNPRNVHIQELFTVPPEQERHYFPVRSRLNKILLSVERTARLLEPLIPSMLRRRALKKAETWFTERLNGEDGLGGIFPAMVNAHESLILLGYSPDHPWRVQAKKALQNLVIEEKNSASCQPCLSPIWDTGLAALALQETEGGHTTAPVIRALDWLKERQILEQSGDWQVQHPNLKGGGWAFQYNNSYYPDLDDTALVAWSMDQAATPERYGEAIGRACDWLCGMQSRNGGFAAFESDNTHYYLNEIPFADHGALLDPPTADVTARCIVLLGRLNKPQYAETLQRALDYLRREQEPNGSWFGRWGTNYIYGTWSALTALEQANIDPQEGFIRKAVEWLKQVQRLDGGWGEDNYSYFDSSLAGRYQESTPVHTAWALLALMAVGEANSEAVKKGIAYLLQIQQEDGLWDHPAFNAPGFPRVFYLKYHGYDKFFPLWALARYRNHLNRQC

SEQ ID NO: 181 - protein, 666 aa, Nitrosomonas europaea
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVV

SEQ ID NO: 182 - protein, 670 aa, Nitrosomonas eutropha
MSISQAFFRTLIQKSSLSDSSLVSENFPADDVAGNEANEISAVTLDEAITRAYTALLAQQREDGHWCFPLEADCTIPAEYILMMHFMDEVDTVLERKIANFLRTRQVTDGHGGWPLYYGGDFDMSCSVKTYYALKLAGDSPEAAHMVHARNAILERGGAARSNVFTRLLLAMYRQIPWRGVPFVPAEIMLLPRWFPFHLSKVAYWSRTVMVPLSILCTLKAKAINPRNVHVQELFVVDPVKEKNYFPVRTSLNRLLLYVERLASKLEPFIPSFIRRRAVKKAEQWVIERLNGNDGLGAIFPAMVNAYEALTLLGHDRDHPLLQQCRQSLRELLVDEGEEITWCQPCVSPVWDTVLATLALQEDKQADSEPIRRALDWIVPLQILDEPGDWRDSRPNLLGGGWAFQYANPHYPDLDDTAAVAWALIQTGAEDYRVSITRAADWLAGMQSSNGGFAAFDIDNAYYYLNEIPFADHGALLDPPTSDVSARCVGLLALNGEVRHQEAVKRGLDFLFNEQESSGAWFGRWGSNYIYGTWSVLEAFRLARVDKGHQAVQRAIQWLESVQRADGGWGETNDSYLDPQLAGQLEASTSFQTAWAVLGLMAAGEVENTAVRKGIDYLLRTQIATGLWEEPWFTAPGFPRVFYLKYHGYSKYFPLWALNRYRTLSSKSAV

SEQ ID NO: 183 - protein, 665 aa, Nitrosomonas sp. AL212
MDGSQRISDMSQQPEGIAVSDEISSAYSVSSLNQDEINVDELENKLTQARSAMLSLQKPDGHWCFPLEADCTIPAEYILMMHFMDEIDVILENKIARFIREKQDLTHGGWPLYYGGAFDISCTIKSYYALKLVGDSPDAAHMVRAREAILERGGAAKANVFTRLLLAMYEQIPWSGVPVVPTELMLLPSWFPFHISKVSYWSRTVMIPLSILCTIKARAINPRNVDIRELFIVPPEQEKNYFPQADTWLKRAFMLVERVLSRVEPKLPQAIRQYSIRKAENWTLERLNGECGIGAIFPAMVNAHESLALLGYAYDHPSRVQCRNALRGLLVDEGERAWCQPCTSPVWDTVLTCLALQEDPAADQGPVLKALDWLVDQQVLDEPGDWRDKRPDLLGGGWAFQYANPHYPDLDDTAAVAWALDQSDAQRYQKPLDRAANWLAGMQSRNGGFAAFDIDNTYHYLNEIPFADHGALIDPPTSDVTARCVGLLGKYGKHQREVWRGISFLLREQEKNGSWFGRWGTNYIYGTWSVLEAFQLANFDMQHTSVRRAVKWLESVQRVDGGWGETNDSYLDIQLAGQFPQTSTTFQTAWAVLGLMAAGEVNSKSVRRGINYLLHNQADDHLWEDPWFTAPGFPRVFYLRYHGYSKFFPIWALVRYRALTKERVS

SEQ ID NO: 184 - protein, 653 aa, Nitrosospira multiformis
MKKFGGMARTSLQAQSPGSNNTPSMDEKMLKAGLEAARGALLAQQREDGHWCFPLEADCTIPAEYILMMHFMDEVDLDLEVRIARFIREKQDVAHGGWPLYYGGEFDLSCSVKAYYALKIVGDSPDAPHMVRARAAILKHGGAARANVFTRLLLAMYDQLPWRGVPFVPVEIILFPKWFPFHTSKVAYWSRTVMVPLSILCSLKARAANPRKVAIRELFTVPPGEERNYFPVRTALNRVFLLIERTLSLLEPFIPQGVRRLALRRAESWIVERLNGDSGLGAIFPAMVNAGEALALLGYPYDHPAREQCRKALRLLLVEEGERTWCQPCVSPVWDTVLTCLAFQEDTEVDQKPIRKALDWLVPCQVLDAPADWQEDHPGLPGGGWAFQYANPHYPDLDDTAAVAWALYQADPKAYQESISRAADWLAGMQSSNGGFAAFDSDNTYYYLNEIPFADHGALLDPPTSDVSARCAGFLALYGQSRHKQALERSLAYLFNEQEASGAWFGRWGSNYIYGTWSVLEAFRLAGIDAGHPAIRRAVHWLKSVQREDGGWGESNDSYLSPQQAGQFHTSTSFHTAWALLALMGAGEWRSHEVHRGIAYLLREQDSDGLWHEPWFTAPGFPRVFYLKYYGYTKYFPVWALTRFHALNRKFPG

SEQ ID NO: 185 - protein, 638 aa, Nostoc punctiforme
MQTQDRVKVNQVAEAIAASQQYLLSIQNPAGYWWAELESNVTITAETVLLHKIWGTDQTRPLHKVEAYLRQEQRQHGGWELFYGDGGELSTSVEAYMALRLLGVPATDPAMIRAQAFILQRGGISKTRIFTKLHLALIGCYNWRGIPSLPPWIMLLPKAFPVNIYEMSSWARSSTVPLLVVCDRKPVFITDPTINLDELYAEGIDRVRWELPQSGDWTDLFLTLDQGFKWAESLNLVPFREEGIKAAEKWILERQEATGDWGGIIPAMLNSMLALRCLDYDRSDPIVERGLQAIDNFAIETDNSYRVQPCVSPVWDTAWVMRALVESGFVPDHPAVVKAGEWLLQKQILDYGDWAVKNRQGKPGAWAFEFENRFYPDVDDSAVVVMALHLAKLPNEKIKQAAIARAVNWIASMQCKPGGWAAFDLDNDQDWLNSIPYGDLKAMIDPNTADVTARVVEMLGACDLSIDSDNLERSLTYLLREQETEGCWFGRWGVNYIYGTSGVLSALALIDPQRHKLSIERGAAWLLGCQNLDGGWGETCRSYDDPSLKGKGDSTASQTAWALIGLLAAGEATGKLAVKAIEQGIGYLMATQQPDGTWFEANFTGTGFPCYFYLKYHLYQQYFPLIALGRYQAAIKES

SEQ ID NO: 186 - protein, 637 aa, Nostoc sp.
MRTQDRVQVNSIAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKSL

SEQ ID NO: 187 - protein, 654 aa, Oligotropha carboxidovorans
MTSDTASAAALDPRRLATSITRASRALHDVQQPDSHWVFELEADVTIPAEYVMMRHYFAEPVDAEIEAKIAKYLRRMQNDNGGWSLFYGHEFDMSASVKAYYALKMIGDSPDAPHMKKAREAMLARGGASRANVFTRIMLALFGQVSWKAVPMMPVEIMLLPRWFPFHLTKVSYWARTVIVPLLVLMTLKPRAKNPRGIGVRELFLEDPQTVGPTPKAAHQSQLWFTSFDIIDRVLRITDPFFPKGMRKRAIAKAEAFVTERLNGVDGLGAIFPAMVNSIMMYDVLGYPPNDPNRALARESVERLLVIKDDEAYCQPCVSPVWDTALAAHSMLESGEAADIEAAKAGLDWLLPRQVLDLKGDWADKRPDVRPGGWAFQYNNAHYPDLDDTAVVVMAMDRVRRLDGTTKYDEAIARATEWILGLQSENGGWAAFDADNLEYYLNNIPFADHGALLDPPTEDVTARCLSMLAQLGDTLETSEPMRRGVEYLRKTQLPDGSWFGRWGINYVYGTWSVLCALNAVGVPHDDPMIAKAADWLESIQNEDGGWGEDGNSYKLNYKGYERAATTASQTAWATLALMAAGRVDRDATQRGIDNLVQSQEADGFWGEPYYTGGGFPRVFYLRYHGYSKFFPLWAMARYRNLRSSNSRFVGAGM

SEQ ID NO: 188 - protein, 609 aa, Paenibacillus sp.
MRSELLQLQSADGSWRLCFDSGTMPDSYFIIILRMLGYSQDEALIRQIASRILSRQLPNGTWKIYPDEEDGNLDATAEAYFALLYSGFLTKLDPRMQLAKQFILSKGGLSKIRSLLTQAIFAAAGQASWPKSMRIPLEVFFSDNGIGIDLFSLSGHARVHIVPIIMLANAQFVQHSASMPDLSDLFAGSSKRFENDSPWIAALATLIGSLSLSELLPFESPTPQEKAVQFLFDRLEPDGTLLTYTTATMFMILVLLMLGYSSSSPLIHRMVSGIHSVICANSHVQIASSEVWDTAMLVHALRKAGVNPTSTALENAGAYLRQRQQTQLGDWAIRNPGTPAGGWGFSNVNTLYPDVDDTTAALRAIQPYSSRTPELQADWQRGLNWVLTMRNDNGGWPAFERQGSRLPITFFNFEGAKDIAVDPSTVDLTSRTLQFLGQELGMNAGNSWIESTLRWVLSQQESNGSWYGRWGITYVHGTSAALQGLTAVGIAEDHPAVKKGVDWLLQVQNEDGGWGESCISDKVRRYVPLNFSTPSQTAWALDGLTAALPKPTPALERGVDALLQSLDRHDWTYTYPTGGALPGSVYAHYASNNYIWPLLALSNIWQKYS

SEQ ID NO: 189 - protein, 609 aa, Paenibacillus sp. JDR-2; identical to SEQ ID NO: 188

SEQ ID NO: 190 - protein, 642 aa, Paenibacillus sp. oral taxon 786
MALSNGEIREEIQRLSEELIQRQEPDGSWRFCFENGITIDACTIILLRTLNVDKEELIRQLHDRIVAAQQPEGCWRWYHDDKEGHLSATVEAYYALLCSGYSRPEDEPIQRAKRYILDRGGIGQARSLFTKAILAATGQRKWPASLSLIPIEILLLPESLPLNFYDFSGYSRVHLVPLLIMAERNFRTRSVRTPDLSELFLDARNGEEDPLTLTPESREPLKLIQSGLAHLVGTPRRIRQAAVNRAEQYMLDRIEGDGTLYTYASCTVLMVFALLALGYEPQHPVIQRAVEGLSQMKFTVDSTGQGGTRYVTIQNSPSTVWDTALISYALQEAGVSSSHPAIQRAADYLRNRQHRRPGDWQIHNPGIVPGGWGFSETNTFVPDVDDTTAALRALSALHGSEPAVLGAWNRGLNWVWSMQNNDGGWPAFEKNTNKEMLTWLAIEGAKSAATDPSEADLTGRTLEYLGNFAKLSVRQDWVARGADWLLSHQEADGSWYGRWGICYIYGTWAALTGLMAVGMPADHPGIAKAANWLIRIQNADGGWGESCRSDQVRRYVPLHASTPSQTAWALDALIAVHDRRAPEIERGVARLIALLHEDDWPSTYPTGAGLPGYFYVHYHSYRYIWPLLALSHYVNKYGDSSP

SEQ ID NO: 191 - protein, 603 aa, Paramecium tetraurelia
MIKKILVLILLMVVVTSKVDIERVQTVIRDAREICWNELTDNEWVYPTYLGTLFLSEYYFELKALGIQNSQFEESKFTQILLGSQLPDGSWVQVEDAYIQTGQLDATIFNYWYLKAVGIDIHTDTMKKAQEWIKANGGIEKAQTMTKFKLAMFGQYPWKKLFKIPLILFYKKFNPLYIKDITAQWVYPHMTALAYLQNQRIIFNVAVSISELYKNKAPKIKNHQKKGRPSFFINNLVQEMLKLRQPMGSFGGYTVSTLLSMLALNDYTGRTNKHKSEISDALKKGLDFVEFNYFNFRQAYHGSLDDGRWWDTILISWAMLESGEDKEKVRPIVENMLQKGVQPNGGIEYGYDFGYAPDADDTGLLLQVLSYYGTDYADAMDKGAEFVYSVQNTDGGFPAFDKGKMGKNPLYKYAFKIAGIADSAEIFDPSSPDVTAHILEGLISSDRSNYDVVVKSLKYFMDTQENFGSWEGRWGINYIYAAGAVLPALKKMNNGWAKAVNWLVSKQNADGGFGETTLSYRDPKKYNGIGVSTVTQTSWGLLGLLAVEDHYDVKEAIEKARDGEFKDISVVGTGHRGLLYLQYPSYARSFPVISLGRFLDQQR

SEQ ID NO: 192 - protein, 737 aa, Pelobacter carbinolicus
MDKIKMKNINQPKFRVFRGGQKAATPCPGTTNERRGALDRGRLSASLKHSREWLLSLQADAGNWVFALEADTTIASEYVMLQRFLGRPLAPELQQRLANYLLSRQLPDGGWPLYAEDGFANISTTVKAYLALKLLGYPTHCDPLVRARQIVLALGGAEKCNVFTRIALALFGQIPWRTTPAMPVEIMLLPRWFYFHLSKISYWARTVVVPLLILYAKRPVCRLEPWEGIPELFVTPPDKLGYLDVCKPGQWRKNVFIWVDRLTRKMVRCVPRRLHNLALRAAETWTREHMQGAGGIGAIFPAMANAVMALRTLGCSPDDADYQRGLKALDDLLIDRCDVPPREDTPVSPCWCTGTSAAPMLDPSPAGSHAQGGDQGICQPCASPIWDTGLALTALLEGGLDARHPAVDRAVRWLLDQQVDVKGDWAQRVPNLEAGGWAFQFENALYPDLDDTSKVLMSLIRAGAMDNPGYRQELSRAINWVIGMQNSDGGWGAFDVDNNYLYLNDIPFADHGALLDPSTADVTGRCIEMLAMAGFGRDFLPIARGVDFLRREQEDFGGWYGRWGVNYIYGTWSALSGLIHAGEDLQAPYIRQAVGWLESVQNPDGGWGETCYSYDDPALAGRGVSTASQTAWALLGLMAAGEVDNLAVRRGIQYLVEEQNRAGGWDERHFTGTGFPRVFYLRYHGYSQYFPLWALGLYERLSSGNPSRQQMVRRAGPAGLHLPVLDRRKKLRRKRKA

SEQ ID NO: 193 - protein, 695 aa, Pelobacter carbinolicus
MNVIRQLNSGVNAAKSLDDGIESAIEWLAENQDKEGFWVGMLESNSCIEAEWILAMHLLGVKDDPKYDKVVQAILNEQREDGSWAVYYDAPAGDINATVEAYAALRTAGFGAGDERLIKARNWIFSHGGLKNVRVFTRYWLALIGEWPWDETPALAPEIIYLPAWCPLNIYDFACWARATLVPLSVLSVRRPVKPLPAESRLDELFPEGRENADYSLPESEKGLAERFFLVVDWFLKKYNRLPMQFGREKAIRLCLEWIVRHQDYDGGWGGIQPPLIYSLIALNTEGYGINHPVISKGLDAFNPPWAYEKNGGVYLQCSESPVWDTLFTMLALFESGCSFDDTPMMRPALDWILSKQITSWGDWQVKVRGVRPGGWAFERANTAYPDVDDTALALVVLAEARRHVKDSAAVDAALERAEEWILGLQCRNGGWAAFDRDNNSAIVTKIPFCDFGEVLDPPSVDVTAHVVEALAALGRDRHDPVVARALKYIRSEQEPGGSWFGRWGVNHIYGTCAVLPALAAIGEDMRAPYVLRAADWLVRHQNDDGGWGESCASYMDDSQCGQGSSTASQTGWALMALVAMSSHDYDEAIRRGLDYLLSHQKSGTWDEPQYTGTGFPGYGVGERTNLKEAGATLDQGCELARGFMINYNMYRHYFPLIAMARARRHLGLAANPRHQDSRSSVEVAPEALRGRACG

SEQ ID NO: 194 - protein, 719 aa, Pelobacter propionicus
MKKATRSVFSLLDGGKISDSGSRGDSRHAGSRLDSVTKSAAALLASRQNPDGHWVFDLEADVTIPAEYVMMRCFIGEPLDSDMASRLSAYLLERQLPDGGWPLYAVDGNANISATVKAYFALKLLGHDKYAPHMVSARRMILAQGGAERSNVFTRITLALFGQVPWHTTPAMPIEIMLLPKWFFFHLSKVAYWSRTVIVPLLILYNKQPVCRLGYSEGIAELFSTSPDMLVHLDHFRYRAWRKNAFIVLDRLLKRTMHLVPGRIKRRALEEAERWTRERMKGDGSIGAIYPAMANAVMALKTLGCGDSDPDYLRGLRAIDRLLIHGKPEAGALPADGAGTLFPVLDGASSAAVDLYPASLSDTAKSHAFSFCQPCNSPVWDTALSLTALSEAGGGGYSPERAMEWLFNRQIATQGDWTERCPGLECGGWAFQYENALYPDVDDTAKVLMSLFRAGALERGEYPEKIAKAVRWVLGMQGADGGWGAFDVDNNHFYLNDIPFADHGALLDPSTADLTGRCIEMLGMLGHGPDYPPITRGIEFLREEQEPFGGWFGRWGVNYIYGTWSVLSGLSQAGEDMGRPYVRKAVEWLVSCQNDDGGWGETCASYDDPSLAGSGASTASQTAWALLGLMAAGEADHAAVRAGIAYLADSFADGWDERHFTGTGFPRVFYLRYHGYSLFFPVWALGVYARHREGGKTVQEQVRERGVNGVFDFVMGGSA

SEQ ID NO: 195 - protein, 679 aa, Pelobacter propionicus
MNPAKYKISSSLTSLNAEPVEQAPLPAKRTGSKVHRLPPSIWKKMVAEAKSPLDKGIERTRDFFLREQLPDGYWWAELESNVTISAEYVMLFHFLGMVDRERERKLANYILAKQTSEGFWSLWHNGPGDLSTTIEAYFALKLAGYSADHPAMAKARAFVLANGGIIKARVFTKIFLALFGEFAWFGVPSMPIELMLLPDWAYFNMYEFSSWSRATIIPLSVVMSERPVRKLPPRAQVQELFVRPPRPTDYTITREDGLFTWKNFFIGADHLIKVYESSPIRPFKKRAVALAENWILEHQEQSGDWGGIQPAMLNSILALHCLGYANDHPAVAKGLDALANFCIEDDDCIVLQSCVSPVWDTALALVALQEADVPADHPALVKAAQWLLNLEVRRKGDWQVKCPELEPGGWAFEFLNDWYPDVDDSGFVMLSIKNIKVRDRKHREEAIKRGIAWCLGMQSENGGWGAFDRNNTKYLLNKIPFADLEALIDPPTADLTGRMLELMGNFDYPKSHPAAERALAFLKKEQESEGPWWGRWGVNYLYGTWSVLCGLEAIGEDMNQPYIRKAVNWIKSRQNNDGGWGEVCESYFDRSLMGSGPSTASQTGWALLALMAAGEANSRAAAQGVKYLLETQNEDGTWDEDAFTGTGFPKFFMIKYHIYRNCFPLTALGRYRRLTAAKG

SEQ ID NO: 196 - protein, 669 aa, Penicillium chrysogenum
MSMTSREDHDASSLISQVEHALKLSNDYALGLVHPDGHWYGEMNTNVTVTAEYVFLRQALRLDLKTDIAAYCHYLLSQQNSDGSWGLAPEYPGDVSTSTEAYLALKILGTSPHTPAMRNARAFVLKAGGIARVRIFTRIFLATFGLFPWSAVPELPVELMLLPSICPINIYKFASWARGTIAPLLIICHHQPVYSLPNGKSTDNDYLDELWVDCTNKSVPYGLPLWDLMSQGEFAGLAFGVLDKVLYQLNGLRSIPLIRAYARKQCIQWILERQEKTGDWAGIFPPMHANMYAFTLEGYKLDDDPVRLGFQALERFAWEDEKGKRIQACVSPVWDTALMTIGLCDAMSPNKQTIDHALAWIRARQLLEPRGDWRVYRPQLAPGGFSFEYENSWYPDVDDTAAIILAQVKHDNGSIGSNSVIAAATWILGMQNPDGGWAAFDVENDKLFLNKIPFSDMDSLCDTSCADITGRILEAYGLMMMKYFSAKSDADPLLHTLRAACMRGMHYLASTQEPNGSWYGRWGCNYIYGTSHVLCGLAYFVEKRLVCVMVKSALQWLKSRQNDDGGWGESLLSYQSPDREQQASTPSQTAWALMGLLSHLPVTDDAIERGIRYLVSSQRPEKGIGSSWPQAEYTGTGFPNHFYLGYDYYRHYFPMMALGRYLQGSRGLN

SEQ ID NO: 197 - protein, 705 aa, Planctomyces limnophilus
MTSGTFGAKRVDLLAAFEHSAPAEKTRETCVGLQTAIARTRQYLLDQQHSEGFFVAELEGDTILESEYILLLAFLNEGQSPDAQAAARYLLTKQNTDGSWSNFPGGPIDVSCAVKAYLALRITGHAADEPALIRAREAILQAGGVERVNSFTRFYLAMLGLIPYSLCPAVPPEVVLLPDWFPINLSQMSAWSRTIVVPLSLLWAFQPAVELNDADGHQITIEELYASPEKQLPRFIRGVNHESNSNGWMNWSRFFFRVDQCLKSIESYGIKPLRSRAVRKCVQWILDRQEMSDGLGAIFPPIVWTLIGLKCAGFDDQHPMVQKQRDELNRLMLREQDALRLQPCLSPVWDTAISIIALRESGVEPDHPALSKARNWLLSKEVRHAGDWSKAHPETPVSGWYFEFNNEFYPDVDDTAMVLIALASTLPEEATPLAISHGVLPVQTGWSAESTSRVQALKQLENHRPVLEAMGRGVQWLKALQSKDGGWGAFDSDINKELLTKVPFADHNAMLDETNADISARVLEAYAAVGISFNDPSVQRALEFIWNDQEDDHAWYGRWGVNYIYGTWQVLVGLTAIGISAHDPRLVRAAGWLKSKQQACGGWGETPATYDNPTLRGQGTPTASQTAWAVLGLIAAGEQNSIECQRGVEFLLKTQKHNGTWDEEEFTGTGFPRVFYLRYHYYPLYFPLMALGRFARAGGRVNFAG

SEQ ID NO: 198 - protein, 697 aa, Planctomyces limnophilus
MEDLTQKLQQALQLASRALLNERVRPGLAHWEGELSTSALSTATAVMALFQYAKCQQASGRLQKVFDGKSEGDWRLIEQGLAWLLQHQLADGGWGDTDKSISNISTTMLAHATLVACREAVRQKSLVLNASDIDAAIERSGRLIEELGGIQAIRDRYGKDHTFSVPILTHAALAGLVSWNEIPALPYELALLPHRFFEVIQLPVVSYALPALIAIGQTLHLRQRTWNPWWWVRRAAIPGTLQKLQSIQPESGGFLEATPLTSFVTMCLASVGRVDHPVTQAGLKFIRDSVRPDGSWPIDTNLATWVTTLSINHLGAEAFSSDEREALMRWLLQQQYRTMHPYTNAAPGGWAWTNLSGGVPDADDTPGAMLALMELDRVSVSSQESLSIEQALYQAALWLIKLQNRDGGWPTFCRGWGALPFDRSSNDITAHCLRALIQYERRLNDVTVDATGDTTSRPLAVEVPSPKLREQMQRSIQQGFEYLEKTQREDGSWLPLWFGNQHSPDDENPLYGTARVLLAYADAGLEGSSAALRGCDWLVRHQHADGAWGPGTSIETADTSDAESDVEGEPASIEETALALMALCRFDATHNVLHRGASWLITKVENETWREPTPIGFYFAKLWYYEKLYPQVFTVGALKALALRLGSALTTVSENEPAPSSAEPPIPPIATDRVADSMHLQRTSPSINLANGGITLA

SEQ ID NO: 199 - protein, 620 aa, Planctomyces maris
MSETISCQRIQAAYQRSRAELLSLRNSTGHWTGELSTSALSTATAIMALEMIRRKRLPADLSLNTYIDNGIRWLAEHQNSDGGWGDTVKSFSNISTTMLCHAVFHATKSTEQYVSHVVNARQYIDRVGGVEAVVARYGKDKTFSVPILTHCALAGLVKWKTIPALPFELACLPARFYKTVRLPVVSYALPALIAIGQVRHHFCKPRNPITRLIRKLAVKRSLKKLISIQPSNGGFLEAAPLTSFVTMSLAGMGLTDHPVVQKGLQFLLDSVRPDGSWPIDTNLATWTTTLSVNALEGTLAEFEKTPIREWLLQQQYKELHPYTSAEPGGWAWTDLPGGVPDADDTPGAILALLNLQPDEPDTQQPADLQVALRNGVKWLLDLQNSNGGWPTFCRGWGALPFDQSAADISAHVIRALQAWLQTEPESAEAELRLRAERAVRKCFKYLATVQRPDGSWLPLWFGNQHVENDENPVYGTARVLAAYAQGEQCGSIQAEQGILFLKSVQNLDGGWGGATSAPSSVEETALAVDTLLALGLEPADPVVAQGLNWLSGRVENGTYTETTPIGFYFAKLWYFEQLYPIIFTVSALHRAETVLKKSADDNLRLSLEEEDYPIMSVKEK

SEQ ID NO: 200 - protein, 770 aa, Polypodiodes niponica
MALPFNQDSYKGDDEADVSKGAAKSPPSLEEAIQRSQEFLLAQQFPEGFWFGELEANVTIISHTVILYKLLGIEENFPMYKFERYLRRMQCSHGGWEIAYGIGSYLSATIEAYIALRLLNVPQSDPALQKALRVILDSGGVTKARIFTKICLALLGSFDWRGIPSLPPWLILCPTWFPLSIYEVSSWARGCIVPLLVILDKKPVFKVSPEVSFDELYAEGREHACKIIPISGDWTSKFFITVDRVFKMMERLRVVPFRQWGIREAEKWILERQEESGDYVNIFPAMFYSVMCMKVLGYETTDPVVQRALLGFKGFTIETADECKVQSTVSPIWDTAFIVRALVDSGIPPDHPALQKAGQWLLQKQILKHGDWAFKDRQNPVNQRGFACLQRDSQIETADECRVQSTLSPVWDTAFVVKALVDSGIPPNHPALQKAGQWLLQNQTLTHGDWAFKTQSGHLAAGGWAFQSHNRWYPDADDSAAVMMALDCIELPDEDVKNGAIARGLKWISALQSRNGGWAGYDKNCDQQWINKVPFNDLNGILDVPTADVTARVLEMVGRLSRLGAVGTPYSPRHCTLVESIPHLLLPETIARGLAYLRREQEGEGCWWGKWGVNYIYGTCGALLALSQVAPTTHQEEIARGAKWLAQVQNRCDKQKAAQGPRDGGWGESCFSYDDPALKGQNDASTASQTAWAVQGLLAAGDALGKYEVEAIEQGVQYLLATQRKDGTWHEAHFTGSCFAQHFYVRYHYYAQHFPLSALGLYRTRILQHQ

SEQ ID NO: 201 - protein, 692 aa, Polypodiodes niponica
MLPYNQNSYKEALHGGHAAHNPPTLEEAIKRSQEFLLAHQHPEGFWWGDLECNVTSASHTLILYKILGIADRYPLHKFEKYLRRMQCSHGGWEMSFGDGGYLSATIEAYICLRLLNVPQSDPALQRALKNILARGGVTKARVFTKVCLALLGGFDWAALPSLPPWLMLFPAWFPWNIYEAASWARGCVVPLIVLLEKKPVFQVKPEVSFDELYVEGRAHACKALPFSAHDWVSNIFVAADRAFKLMERFGAVPFRQWSIKEAKKWVLDRQEEMGDFIGYNPPMLYFAVCLKLWGYEVTDPLLQRALLAHKKLTVETEDECWLQSSQSPVWDTALVIPALVESGLPPDHPALQKAGQWLLEKQILKHGDWALKTGGGRMQDDIGGGWAFQFVNSWYPDVDDSAAVVIALNCIKMPDEDVKNGAIARCLKWIAFMQGRNGGWAAFDRDSNQRWMDATPFSDIEAMLDVSTADVTARVLEMVGLMRLKHAAQPANNSLGKAHRHISTESIARGVDYLTKEQEKEGCWWGRWGVNYIYGTRGALMGLSQVAAKTHKKEIARGAAWLVKVQNKKNEKKQGAQDGGWGEACFSYDDPATKGQNSRSTASQTGWAMQGLLAAGEVLGRKYEMEAVEEGVQFLLDTQRKDGSWSEAEFTGGGFPKHYYLKYHYFAQHFPLSALARYRARLLQLSRPKNQA

SEQ ID NO: 202 - protein, 355 aa, Populus trichocarpa
MVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHG

SEQ ID NO: 203 - protein, 673 aa, Ralstonia eutropha
MSMNEAVLAAPRAAVATAAPALQAPIEALSPLDAGIGHAVDALLAQQNADGHWVYELEADATIPAEYVLMVHYLGETPDLSLEARIARYLRRIQNADGGWPLFHEGRSDISASVKAYFALKMAGDDPQAAHMARAREVILAMGGAETSNVFTRTLLALYGVMPWQAVPMMPVEIMLLPQWFPFHLSKVSYWARTVIVPLLVLNSLRPQARNPRKVGIDELFLGSRDAVRLPPRAPHQHKGWHALFHGADVLLRTAEHVMPRGLRRRAIDAAKAFVRERLNGEDGLGAIFPAMANSVMMFDVLGVPPDDPDRAIARRSIDKLLVVHGDEAYCQPCLSPVWDTALAAHALLEASEPRATAAVTRALDWLRPLQVLDVRGDWTVRRPDVRPGGWAFQYANPHYPDVDDTAVVVAAMHRAARTDHSGRADPNAEATARAIEWIVGMQSANGGWGAFEPENTHLYLNNIPFADHGALLDPPTADVSARCLSMLCQTGATPDKSEPAARALQYLLAEQLPDGSWFGRWGTNYIYGTWSALCALNAAGLGPDAPPLRRAAEWLVAIQNPDGGWGEDGDSYKLEYRGYETAPSVASQTAWALLALMAAGQAAHPAVTRGIDYLLRTQQADGLWHEPRFTAVGFPRVFYLRYHGYARYFPLWALARYRNLERSGNRQVAWGL

SEQ ID NO: 204 - protein, 672 aa, Ralstonia eutropha
MSMNETAFATAVPRIAPASAGDSPAPRDAAQALDQGIGRAIDALLHQQRPDGHWVYELEADATIPAEYVLMVHYLGEAPDLELEARLARYLRRIQNPDGGWPLFHEGRSDVSASVKAYFALKMAGDDPQAAHMQRARRAVHALGGAEASNVFTRTLLALYGVMPWLAVPMMPVEIMLLPQWFPFHLSKVSYWARTVIVPLLVLNSLRPQARNPRGVGINELFVGNCHTVGLPPRAAHQHAGWYTVFRGLDALLRVAEPLVPRTLRRRAIAAAQAFVRERLNGEDGLGAIFPAMANSVMMFDVLGVPPDDPARALARQSVERLLVEHGDEAYCQPCLSPVWDTALAAHALLETGEARATAAAGRGLDWLRPLQVLDVRGDWAVRRPLVRPGGWAFQYANAYYPDVDDTAVVAAAMNRYMRAHDVPGRYDEAVARAAEWIVGMQGGDGGWGAFEPENTHLYLNNIPFADHGALLDPPTADVSARCLSMLCQIGATPGKSEPAARALRYLLAEQMPDGSWFGRWGTNYIYGTWSALCALNATGLAPEAPEMRRAVAWLEQIQNADGGWGEDGSSYRLDYRGYEPAPSVASQTAWALLALMAAGAAQHAAVARGIDYLLRTQQSGGLWHEPRFTAVGFPRVFYLRYHGYARYFPLWALARYRNLQRGGAHQVPWGL

SEQ ID NO: 205 - protein, 669 aa, Ralstonia metallidurans
MNQAATITRPQDETLTTSARRPAQPALPDPLDAGIAHVVESLLAQQQSDGHWVYELEADATIPAEYILMVHYLGETPDLVLEGKIANYLRRIQNADGGWPLFHAGASDISASVKGYFALKMAGDNPEAEHMRRARAAIHAMGGAEASNVFTRTLLALYGVMPWQAVPMMPVEIMLLPEWFPFHLSKVSYWARTVIVPLLVLNSLRPQARNPRKIGIDELFVRPCQATRLPRRAPHQSPLWVGVFRTLDAVVRMAEPLFPRGLRQRAIERAREFTVERLNGEDGLGAIFPAMVNSVLMFDVLGVPESDPNRAIARRSIDKLLVIKDDEAYCQPCLSPVWDTSLAAHALLEVGEPRTIAAAARGLDWLLPLQELELRGDWTVRRPNVRPGGWAFQYANPHYPDVDDTAVVAAAMDRVDKGDRSNRYDEAVSRACEWIVGMQSSNGGWGAFEPENTHLYLNNIPFADHGALLDPPTADVSARCLAMLCQLGQMPANSEPAARALRYLLDEQEADGSWFGRWGTNYIYGTWSALCGLNAAGIGTDAPEMKRAAQWLLSIQNEDGGWGESGDSYKLEYRGYEKAPSTASQTAWAMLGLMAAGAGDHPALVRGVEYLLRTQASHGFWDEPYFTAVGFPRVFYLRYHGYSRFFPLWALARFRNLLRDGNRAISWGL

SEQ ID NO: 206 - protein, 661 aa, Ralstonia metallidurans
MTRKTIPASELDAAIVRARDALLDRQHPDGHWCFELECDATITAEYILMMHFVDEIDTALQARMAKYLRAVQRLDGHGAWDLYFGGDLDISCSVKAYFALKAAGDPPDAPHMVRAREAILARGGAAKSNVFTRILLATFGEIPWRGTPFMPVEFVLFPRWAPIHMDKVAYWARTTMVPLLVLCSIRAAAKNPLGVHVQELFVTPPELEREYFPRKRGLQQAFLVADRVVRHLEPLIPRALRRRAIQRAVEWSEARMNGEDGFGGIFPPMVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHGYTAYFPLWALGRYRRLAAARASAMQTAKAESAESMTAH

SEQ ID NO: 207 - protein, 647 aa, Rhizobium sp.
MNKHSGNRTAIDPAALEMSIASATEALLAYRHADGHWAFELEADSTIPSEYILLRHYLAEPIDVVLEAKIGNYLRRTQGAHGGWPLVHDGPFDMSASVKSYFALKMIGDSVDAAHMVKAREAIRARGGAANSNVLTRFLLALYGVVSWRAVPVLPIEIVLLPIWSPFHLYKISYWARTTIVPLMVLAVLKPRAKNPKGVGIEELFLQDTKSVGMNPKAPHQSWGWFLLFRGIDGILRVIEPHLPKKLRERAIASALAFTEERLNGEDGMGAIYPSMANIVMMYDALGKDDHFPPRAIARRAIDKLLVIGEEEAYCQPCLSPVWDTALTCHALQEVGGANAVAKAKQGLDWLKPRQVLDVKGDWAVKAPNIRPGGWPFQYNNAHYPDLDDTAVVVMAMDRAQRHAGSKEYATAIARGREWIEGMQSRDGGWAAFDVNNLEYYLNNLPFADHGALLDPPTEDVTARCVSMLAQVGEFTQRSKAVAEGIAYLRRTQHAEGSWYGRWGLNYIYGTWSVLCALNAAGIDHQDPMIRKAVEWLVSIQSWDGGWGEDAISYRLDYSGYEQAPSTSSQTAWALLGLMAAGEVEHPAVARGVNYLKNAQTENGLWDEQRYTATGFPRVFYLRYHGYSKFFPLWALARYRNLRSTNV

SEQ ID NO: 208 - protein, 661 aa, Rhodopirellula baltica
MMAVVENSVSEVLDRRELRGTLDLLRGELLAQRTKDGHWTGELSASALSTATAISAMSAAVRSGKLAGADKAALLEQIQSGRRWLADQQNDDGGFGDTDRSHSNIATSYLVLAAWTLSDQVTGETTDANAISRLRNWIQLAGELDGLRRRYGKDKTFVVPILTNMAIAGLVPWKKVSALPFEAAVVPQSMYRFVGMPVVSYAVPALVAIGQVKFLEGGGCLPPWSLVRRAAIEPSMKVLRSMQPSSGGYLEATPLTAFVVMSLSASGRADHEVTQNGLRFLRDSMLPDGSWPIDTNLANWATSLATTALTMDPDDDRSWSTNELIQWQRGCQYQERHPFTGADPGGWGWTDLTGSVPDADDTPGAIISLRMQATTRPDPLCDDYSRDWPASDSSGSVSANALDTWKACDRGVDWLLGLQNRDGGWPTFCRGWGKLPFDRSSNDLTAHALRAIACLPKRESAKRSRAVQRGLRFLRKNQQADGSWLPLWFGNQDRPEEDNPIYGTSRVLVDVSPALGHDAISRGLYYLINSQNSDGGWGGGESVRETFGLPEGFISSVEETALAVEALVSWWGRIPGNEGGQAAENDIPDGSPWDASMRSALRAAILSGTRWLIDAVQRERHQVAWPIGFYFAKLWYYERLYPLVYTTAALGRVMQRDELLR

SEQ ID NO: 209 - protein, 685 aa, Rhodopseudomonas palustris
MDSILAPRADAPRNIDGALRESVQQAADWLVANQKPDGHWVGRAETNATMEAQWCLALWFLGLEDHPLRVRLGRALLDTQRPDGAWHVFYGAPNGDINATVEAYAALRSLGHRDDEEPLRKARDWILSKGGLANIRVFTRYWLALIGEWPWEKTPNILPEVIWLPTWFPFSIYNFAQWARATLMPIAVLSAHRPSRPLAPQDRLDALFPQGRDSFNYDLPARLGAGVWDVIFRKIDTILHRLQDWGARRGPHGIMRRGAIDHVLQWIIRHQDYDGSWGGIQPPWIYGLMALHTEGYAMTHPVMAKALDALNEPGWRIDIGDATFIQATNSPVWDTMLSLLAFDDAGLGERYPEQVERAVRWVLKRQVLVPGDWSVKLPDVKPGGWAFEYANNFYPDTDDTSVALMALAPFRHDPKWQAEGIEDAIQRGIDWLVAMQCKEGGWGAFDKDNDKKILAKIPFCDFGEALDPPSADVTAHIIEAFAKVGLDRNHPSIVRALDYLKREQEPEGPWFGRWGVNYVYGTGAVLPALAAIGEDMRQPYIARACDWLIARQQANGGWGESCVSYMDAKQAGEGTATASQTAWALMALIAADRPQDRDAIERGCLYLTETQRDGTWQEVHYTGTGFPGYGVGQTIKLNDPLLSKRLMQGPELSRSFMLRYDLYRHYFPMMAIGRVLRQRGDRSGH

SEQ ID NO: 210 - protein, 654 aa, Rhodopseudomonas palustris
MDSGTFNPGGERGNTLDASIDAARAALLGYRRDDGHWVFELEADCTIPAEYVLLRHYLGEPIDAALEAKIAVYLRRTQGAHGGWPLVYDGEFDMSATVKGYFALKMIGDSIDAPHMAKAREAILSRGGAVHANVFTRFLLAMFGILTWRAVPVLPVEIMLLPMWSPFHLNKISYWARTTIVPLMVLAALKPRAVNRLGVGLDELFLQDPKSIGMPARGPHQNRGLFALFGAIDAVLRVIEPLIPKKLRKHAIDRAVAFVEERLNGEDGLGAIYPPMANTVMMYKVLGYPEDHPPRAITRRGIDLLLVIGEEEAYCQPCVSPIWDTSLTCHALLEAGGAEAAQPVREGLDWLLPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGAMLDPPTEDVTARCVSMLAQLGETEQTSKAVARGVAYLRKTQLPDGSWYGRWGMNYIYGTWAVLCALNAAGVDHQDPAIRKAVAWLASIQNADGGWGEDGVSYRLDYRGYETAPSTASQTAWALLSIMAAGEVDHPAVARGIEYLKGTQTEKGLWDEQRHTATGFPRVFYLRYHGYSKFFPLWGLARYRNLRATNSKVVGVGM

SEQ ID NO: 211 - protein, 654 aa, Rhodopseudomonas palustris
MTSGTTILGAERGRTLDASIDAARAALLGYRRDDGHWVFELEADCTIPAEYVLLRHYLGEPVDAALEAKIAVYLRRTQGAHGGWPLVHDGEFDVSATVKAYFALKMIGDSIDAPHMAKAREAILARGGAIHVNVFTRFLLSMFGILTWRSVPVLPVEIMLLPMWAPFHLNKISYWARTTIVPLMVLAALKPRAVNKLDIGLDELFLQDPQSIGMPAKAPHQSWGLFTLFGSIDAVLRVIEPLIPKKLRSYAIGRAVAFIEERLNGEDGLGAIYPPMANTVMMYKVLGYGEDHPPRAITRRGIDLLLVVGEEEAYCQPCVSPIWDTSLTCHALLEAGGAEAALPVRKGLDWLIPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGALLDPPTEDVTARCVSMLAQLGETAETSSALARGVAYLRKTQLAEGSWYGRWGLNYIYGTWSVLCALNAAGVAHQDPAMRKAVAWLASIQNADGGWGEDAVSYRLDYRGYESAPSTASQTAWALLALMAAGEVDHPAVARGVEYLKGTQTEKGVWDEQRYTATGFPRVFYLRYHGYSKFFPLWALARYRNLRATNSKVVGVGM

SEQ ID NO: 212 - protein, 654 aa, Rhodopseudomonas palustris
MESGNNKQPAAAIGALDASIESATNALLGYRQPDGHWVFELEADCTIPAEYVLLRHYLGEPVDAALEAKIANYLRRVQGAHGGWPLVHDGGFDMSASVKGYFALKMIGDDIDAPHMAKAREAIRSRGGAIHSNVFTRFLLSMFGITTWRSVPVLPVEIMLLPMWSPFHLNKISYWARTTIVPLMVLAALKPRAVNRLDIGLDELFLQDPKSIKMPAKAPHQSWALFKLFAGIDAVLRTIEPLFPKRLRDHAIKLAVDFVEERLNGEDGLGAIYPPMANTVMMYKVLGFPEDHPPRAITRRGIDKLLVIGEDEAYCQPCVSPVWDTALTCHALLEVGGEAAVPPAKRGMDWLLPKQVLDLKGDWAVKRPNLRPGGWAFQYNNAHYPDLDDTAVVVMAMDRSRRATGSREYDEAIARAREWIEGMQSDDGGWAAFDVNNLEYYLNNIPFSDHGAMLDPPTEDVTARCVSMLSQLGETAASSKAVADGVEYLRRTQLPDGSWYGRWGLNYIYGTWSVLCALNAAGVDHQDPVIRKAVTWLASVQNPDGGWGEGAESYRLNYTRYEQAPTTASQTSWALLGLMAAGEVDSPVVARGVEYLKSTQTGKGLWDEQRYTATGFPRVFYLRYHGYAKFFPLWALARYRNLRSTNSKVVGVGM

SEQ ID NO: 213 - protein, 653 aa, Rhodopseudomonas palustris
MDSGSYTTGVERNALEASIDAARSALLNYRRDDGHWVFELEADCTIPAEYVLLRHYLGEPVDAELEAKIAVYLRRIQGAHGGWPLVHDGDFDMSASVKGYFALKMIGDSIDAPHMVRAREAIRSRGGAIHSNVFTRFLLTLYGVTTWRAVPVLPVEIMLLPSWSPFTLTKISYWARTTMVPLLVLCALKPQAKNPKGVGIDELFLQDPKTIGMPVKAPHQNWALFKLFGSIDAVLRVIEPVMPKGIRKRAIDKALAFIEERLNGEDGMGAIFPPMANAVMMYEALGYPEDYPPRASQRRGIDLLLVDRGDEAYCQPCVSPVWDTALASHAVLEADGHEGAKSVRPALDWLLPRQVLDVKGDWAVKAPNVRPGGWAFQYNNAHYPDLDDTAVVVMALDRARKDQPNPAYDAAIARAREWIEGMQSDDGGWGAFDINNTEYYLNNIPFSDHGAMLDPPTEDVTARCVSMLAQLGETMDSSPALARAVGYLRDTQLAEGSWYGRWGMNYIYGTWSVLCALNAAGVPHADPMIRKAVAWLESVQNRDGGWGEDAVSYRLDYRGYESAPSTASQTAWALLALMAAGEVDHPAVARGIEYLKSTQTEKGLWDEQRYTATGFPRVFYLRYHGYSKFFPLWALARYRNLQATNSKVVGVGM

SEQ ID NO: 214 - protein, 656 aa, Rhodospirillum rubrum
MDATAPLRDPGAPSAENCSVDRRELDDVIGESCRWLGERQNQDGHWVFELEADATIPAEYILLNHFLDEIDDAREARIASYLRAIQGKHGGWPLFHDGDFDMSATVKAYYALKLTGDGVDEPHMVRARQAILEHGGAERTNVFTRFTLAMFDQVPWRACPVTPVEALLLPRFAPFHWSKVSYWSRTVMTPLMILYSRRARAVNPRGIGVRELFRRDPEVIRDWLKNPTGHWIGDALIQIDKVLRVIEPAIHWAFRDRAEKWALDFIEERLNGRDGLGGIYPAIANTLMAYHTLGYAKDHPGYRIAREAVDGLCTPHAKGEYVQPCLSPVWDTCLASHAIQEAGQSAGDRAVDQSNAWLRERQVLDVVGDWKSNRGHLRPGGWAFQYNNPHYPDVDDTAVVVMALARSKEDEANREAIARAEEWIIGMQSSNGGWGAFDAENEHDFLNHVPFADHGALLDPPTVDVSARCLGMLAQLGRPKTDPVVARGLDYLWREQEADGSWFGRWGTNYIYGTWSALNAFNAVEWDMTDPRICKAVDWLKSRQRDDGGWGEDCATYWKERRSVSKASTPSQTAWAVLGLMAAGEVDSPEVERGIRYLLEAPRDGGKWEEELYNAVGFPRIFYLRYHGYSAYFPLWALARYRNLTSGNCKRTIHGM

SEQ ID NO: 215 - protein, 554 aa, Rubrobacter xylanophilus
MGRQTRNLTRREPAAEAEERGFRLLDAHRRADSSWVGELSSSALATAMSALALRLLGHPAESGPVAGGLAWLAATRNPDGGWGDAPGEPSNMNATSIAAAALARCAPRRYREEVAGGRRWVEEHGGFAALNDPRTTTLSGPGRTLWALAGLVPPERVRKLPTEMILLPRRIRRTVSTTFPAFLSLSLLHERFRPSPRWRRPLRRRAEREALAWLRRAQGPNGSYEESAFLTSLIAAALTAAGAEGGDIVRRALPFVLRSRRPDGSWPIDRDLENFDTTQAILAHHEAGRPLREAGRVREWLLDNQFRRPFFPTSSPPGGWAWAYPAGWPDTDDTACALRSLRLLGVPAGHPSIRLGLRWLYRMQNRDGSWPTFVRGSRMPFDHGCPYITSQVLSALALMGPEARRGAPLRRALAYLRRAQRPDGSLGSLWFRPHTRGTAAAVEAFSDLGLSGDPLVGRAARWLAEHQNPDGGWGDGHGAPSTAEETAWASAALLRLGGGEAARKGVRWLVEHQDPGGWKPAVIGLYYASLSYSDTFYALSYPLVALARHRRLSR

SEQ ID NO: 216 - protein, 640 aa, Saccharomonospora viridis
MTDVLTRELSPNSTRDRVRSCVSSARQYLLSLQHEEGWWKGELDTNVTMEAEDLLLRQFLGISDEQVTQETARWIRSCQREDGTWATFHGGPPDLSTTVEAYVALRLAGDAMDAAHLRKAREYILDSGGIESTRVFTRIWLALFGEWPWSRLPVLPPEMMLLPDWFPLNIYDWASWARQTVVPLTIVGSLRPTRDLGFSVRELRTGIQRRDLESPLSWAGVFHGLDSVLHRLEKLPLKPLRKVALARAEQWILDRQESDGGWGGIQPPWVYSILALHLRGYPLDHPVLRKALDGLDGFTIRHRTENGWIRKLEACQSPVWDTALAMTALLDSGTPPNDPALVRAADWILRQEIRVSGDWRVRRPALEPSGWAFEFANDHYPDTDDTAEVVLGLQRVRHPEPHRVNAAVERATAWLVGMQSSDGGWGAFDADNTRTLCEKLPFCDFGAVIDPPSADVTAHIVEMLAARGMADSESARRGVRWLLEHQEVDGSWFGRWGANHVYGTGAVVPALVACGISPQHEAVRAAVQWLVAHQNADGGWGEDLRSYVDRTWVGRGTSTPSQTAWALLALLAAGERGEVVRRGVEWLMAAQRPDGGWDEPQYTGTGFPGDFYISYHMYRIVFPLTALGRYLGRGGDVGTG

SEQ ID NO: 217 - protein, 636 aa, Saccharopolyspora erythraea
MTEEVLQRTAAPAEVLAAAREHLLSLQHERGWWKGELETNVTMDVEDLLLRRFLGILTTAETEQAARWIRSRQRADGTWAQFHGGPGDLSTTVEAYVGLKLAGDDVDSEHMAAARAWILERGGIEETRVFTRIWLALFGEWSWDDLPAMPPELVLLPPWVPLNLADWGCWARQTIVPLTVVCTLRPRRDLGVGLAELRSGRRRRKVPSPSWAGAFQVLDGALHGYQRHPLRGLREHAMRRAAEWIVARQEADGSWGGIQPPWVYSLLALHLLGYPLDHPVLRQGLAGLERFLIREETPEGTVRRLEACQSPVWDTVLSMQALRDAGLAADHPALRRAADFVLAEEIRVKGDWSVRRPDLAPGGWAFEFDNDGYPDIDDTAEVVLALNRVDHERPGAVNAAIDRGVRWMSGMQSADGGWGAFDADNTRELVNELPFCDFGAVIDPPSADVTAHVVEALCVLGRGDGEAVRRGVRWLLDHQELDGSWFGRWGANHVYGTGAAVPALVRAGLRRDHLALRRAVRWLEVHQNDDGGWGEDLRSYDDPVWVGRGRSTASQTAWALLALLAVDLHDTDAVRRGVGFLAETQRPDGTWDEPQFTGTGFPGDFYINYHLYRLVFPVTALGRYEQARREQSGGSG

SEQ ID NO: 218 - protein, 656 aa, Schizosaccharomyces japonicus
MKTDGNTTLDTTISMEELERTVKSAYEALAKDQQDDGHWIYELEADVTIPAQFILLEHTLDKIDEELEQKIANYLRRCQSREHWGWPVYYGGEFNISASVQAYFALKMTGEDINAPHMVRAREAILAHGGPEYANVFTRIQLSLFGEASWLATPFMPVEIMLLPRWMYFSIWNMSYWSRTTVAPLLIVADLKPKAINPRNVHIPELFPTPPDKVKTWIHGPFRSKWGHVFKFIDTAIRPFTRFVPSFLHKKAYKAALDFIEPRLNGVDGLGAIYPPMSYSAVMYRALGIPDDDPRAATNWEALKGLLVIKEREAYCQACVSPVWDTALSGHALMEASFGPDGINADRTEKLIDRAAHWLRAHQVLNVVGDWAINNPNLQPGGWAFQYGNDYYPDVDDTAVAAMLLHRQNLPENEEALDRARKWIIGMQSSNGGWGAFDIDNDKQILNDIPFADHGALLDPPTADVSARCISLLAELGHPEDRPVIERGIKYLRKEQEEDGSWFGRWGTNYIYGAWSVLCAFNASGVPHDDPSVLKCVNFLKSVQREDGGWGESCETYEGSAHGVYTESLPSQTAWAVLGLMASGRRTDPAVKRGIVWLIQHQQDNGEWAEEPFNAVGFPRMFYLHYLGYKQFFPLLALARYRHMEKSGTNNVSFAF

SEQ ID NO: 219 - protein, 617 aa, Sphaerobacter thermophilus
MDPALSRAVDWLLEHQDPAGWWCGEFETNVTITAEHILLLRFLGLDPSPLRDAVTRYLLGQQREDGSWALYYEGPADLSTSIEAYAALKVLGLDPTSEPMRRALQVIHDLGGVAQARVFTRIWLAMFGQYPWDGVPSMPPELIWLPPSAPFNLYDFACWARATITPLLIILARRPVRPLGCDLGELVLPGSEHLLTRVPGSGPFWWGDKVLKRYDHLVRHPGRDRACQRIVEWIIARQEADGSWGGIQSAWVMSLIALHLEGLPLDHPVMRAGLAGFDRVALEDERGWRLQASTSPVWDTAWAVLALRRAGLPREHPRLALAVDWLLQEQIPGGGDWQVRTGTIPGGGWAFEFDNDHYPDIDDTAVVVLALLEAGHEDRVRNAVERAARWILAMRSTDGGWGAFDRDNAREVIHRLPIADFGTLIDPPSEDVTAHVLEMLARLSFPSTDPVVARGLEFLQQTQRPDGAWFGRWGVNYIYGTWCAVSALTAFADTDATARAMVPRAVAWLLDRQNADGGWGETCGSYEDPNLAGVGRSTPSQTAWAVLALQAAGLGQHPACRRGLDFLRERQVGGTWEEREHTGTGFPGDFFINYHLYRHVFPTMALAGAATGMDSPR

SEQ ID NO: 220 - protein, 583 aa, Streptomyces albus
FLGIRDEATTRSAALFIRGEQREDGTWATFHGGPPDLSTTVEAYVALRLAGDSPDAPHMTRAAHWVRSQGGIAEARVFTRIWLALFGWWPWDRLPELPPELIFLPPWAPLNIYDFGCWARQTIVPLTVVSAKRPVRPAPFPLDELHTDPADPAPRARFAPLASWNGAFQRLDRALHAYRKVAPRALRRAAMATAGRWIVERQENDGCWGGIQPPAVYSMIALHLLGYDLGHPVMRAGLESLDRFTLTREDGSRMVEACQSPVWDTCLATIALADAGVPADHPQLVRAADWMLDEQIERPGDWSVRRPHLAPGGWAFEFHNDNYPDIDDTAEVVLALRRVRHPDTARMERAISLGVRWNLGMQSKNGAWGAFDVDNTSSLPNRLPFCDFGEVVDPPSADVTAHVVEMLAAEGLAADPRTRRAVDWLLAEQEPSGAWFGRWGVNYLYGTGSAVPALVDAGLPTTHPAIRRAVAWLESVQNDDGGWGEDLRSYREQGRMARGASTASQTGWALMALLAAGERESRAARRGVTFLAETQHEDGSWEEPYYTGTGFPWDFSINYHLYRQVFPLTALGRYTRGAAPEGA

SEQ ID NO: 221 - protein, 666 aa, Streptomyces avermitilis
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 222 - protein, 639 aa, Acaryochloris marina
MAVRDRVNPKTLEAAIAASQSYLLTQQDETGYWWAELESNVSITSEVVLLHKIWGTDRSRPLEKVETYLRSQQRDHGGWELYFDDGGEISVSVEAYMALKLLGVPMEDPAMVRARQFILEHGGISRTRVFTKLHLALIGCYEWRGIPSLPPWVMLLPEQFPFTIYEMSSWARGSTVPLLIVMDREPVYAVEAGFNLDELYVEGRHRAQFDLPLSNEWTDAFIYLDGLFKFAESTNLVPFREEGIRAAERWILERQEATGDWGGIIPAMLNSLLGLKALDYDVHDPIIERGMAALDAFALETEDQYWIQPCISPVWDTALVVRGLAESGLAPDHPALVKAGEWLLNKQILDYGDWSVKNPGGLPGGWAFEFDNRFYPDVDDTAVVVMALNEVQLPDEQAKDAAIARAVNWIATMQCRPGGWAAFDINNDQDWLNALPYGDLKAMIDPNTADVTARVLEMIGRCHQTTGKNSVDRALRYLRTEQEPEGCWFGRWGVNYIYGTSGVLAALALIDPQGWQSQIQQAAAWLVSCQNTDGGWGETCASYDNPKLKGQGPSTASQTAWAIMGLLSAGEATSVYAEAAIERGVNYLTTTQKMDGTWDEDYFTGTGFPGHFYLKYHLYQQHFPLTALGRYQAMLQQKS

SEQ ID NO: 223 - protein, 666 aa, Streptomyces filamentosus
MTATTDGSTGAANITGAPADDPTDTRTAANDVTDIARRAAERSVEHLLGRQDEQGWWKGDLATNVTMDAEDLLLRQFLGIQDPATTRAAALFIRGEQLGDGTWNTFYGGPGDLSATIEAYVALRLAGDRPDEPHMARASGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRIAMNVAARWIIERQENDGCWGGIQPPAVYSVIALHLLGYDLDHPVMKAGLASLDRFAVHREDGARMIEACQSPVWDTCLATIALADAGLRPDHPALVKAADWMLAEEITRPGDWSVRKPELAPGGWAFEFHNDNYPDIDDTAEVVLALRRVRHPDPARLEAAIARGVRWNLGMQSRNGAWGAFDADNTSPFPNRLPFCDFGEVIDPPSADVTGHVVEMLAVEGLANHPRTREGIEWLLAEQEACGAWFGRWGVNYVYGTGSVVPALITAGLPAGHPAIRRAVDWLESVQNDDGGWGEDLRSYQEEKWIGHGESTASQTAWALLALLAAGRRDTASVTRGVTWLTEAQQADGSWDEPYFTGTGFPWDFSINYHLYRQVFPLTALGRYVHGDPFADRTDAAEGV

SEQ ID NO: 224 - protein, 670 aa, Streptomyces flavogriseus
MTATTDGSTGAANLRAAAASDPTESTSAAPDMMAVARHAAERSVEHLLGRQDEQGWWKGDLATNVTMDAEDLLLRQFLGIQDPETVKAAARFIRGEQLGDGTWNTFYEGPPDLSATVEAYVALRLAGDRPDDPHMIRAAGWVREQGGIAESRVFTRIWLALFGWWKWDDLPELPPELMFFPKWVPLNIYDFGCWARQTIVPLTIVSAKRPVRPAPFALDELHTDPACPNPSRPTAPAASWDGVFQRLDKALHLYHKVAPRRLRRIAMNEAARWIIERQENDGCWGGIQPPAVYSVIALHLLGYDLDHPVMRAGLESLDRFAVWREDGARMIEACQSPVWDTCLATIALADAGVSPDHPALVRAADWMLGEEIVRPGDWAVRKPGLAPGGWAFEFHNVNYPDIDDTAEVALALRRVRHPDPARVDAAIERGVRWNLGMQSRNGAWGAFDADNTSPFPNRLPFCDFGEVIDPPSADVTGHVVEMLAVEGRAHDPRTRRGVEWLLAEQEASGAWFGRWGVNYIYGTGSVVPALIAAGLPAAHPSVRRAVDWLRSVQNDDGGWGEDLRSYREEKWIGHGSSTASQTGWALLALLAAGERETRSVERGVAWLAATQQADGSWDEPHFTGTGFPWDFSINYHLYRQVFPLTALGRYVYGDPFATATAIGAGTGKGA

SEQ ID NO: 225 - protein, 686 aa, Streptomyces ghanaensis
MTATTDGSTGAALPPRVTAASDTDTDIPVAAGVPDIAARAMRRATDFLLSRQSDQGWWKGDLETNVTMDAEDLLLRQFLGIRDEGTTRAAALFIRGEQREDGTWATFHGGPGDLSATIEAYVALRLAGDPPDAPHLARASAWIREQGGIAASRVFTRIWLALFGWWKWEDLPELPPELIWFPAWVPLNIYDFGCWARQTIVPLTIVSAERPVRPAPFPLDELHTDPARPNPPRALAPVTGWDGAFQRLDKALHVLRGAVPRRLRRAAMNTAARWIIERQENDGCWGGIQPPAVYSIIALHLLGYDLNHPVMRAGLESLDRFAVWREDGARMIEACQSPVWDTCLATIALADAGLPADHPQLVKAADWMLGEQIVRPGDWSVRRPHLPPGGWAFEFHNDNYPDIDDTAEVVLALRRVAHHDPERVDNAIGRGVRWNLGMQSRNGAWGAFDVDNTSPFPNRLPFCDFGEVIDPPSADVTAHVVEMLAAEGLAHDPRTRRGVQWLLAEQEPNGSWFGRWGVNYLYGTGSVVPALTAAGISGSHPAIRRAVAWLESVQNDDGGWGEDLRSYRDARGWSGRGASTASQTAWALMALLAAGERESRAVERGVEWLAATQHEDGSWDEPYFTGTGFPWDFSINYHLYRQVFPLTALGRYVNGEPLAGKPRAAGAATAREDTGQEQSLAEAKGS

SEQ ID NO: 226 - protein, 680 aa, Streptomyces griseoflavus
MTATTDGSTGAALPPRVTAASENDTDIPEAAGVPDIAAHAMRRATDFLLSRQDDQGWWKGDLETNVTMDAEDLLLRQFLGIRDEDTTRAAALFIRGEQREDGTWATFHGGPGELSTTIEAYVALRLAGDPPEAPHMARASAWIRERGGIAAARVFTRIWLALFGWWKWEDLPELPPELIWFPSWVPLNIYDFGCWARQTIVPLTIVSAKRPVRPAPFPLDELHTDPRRPRPPRPHAPPNTWDGAFQRLDRALHALRRAVPRRVRQAAMNAAARWIIERQENDGCWGGIQPPAVYSVIALHLLGYDLRHPVMRAGLESLDRFAVWREDGARMIEACQSPVWDTCLAAIALADAGLPADHPSLVKAADWMLGEQIVRPGDWSVRRPHLPPGGWAFEFHNDNYPDIDDTAEVVLALRRVRHHDPERMDSAIGRGVRWSLGMQSKNGAWGAFDVDNTSPFPNRLPFCDFGEVIDPPSADVTAHVVEMLAVEGLAHDPRTRRGIQWLLAEQEPDGSWFGRWGVNYLYGTGSVVPALAAAGIPGSHPAIRRAVAWLEKVQNDDGGWGEDLRSYRHVREWSGRGASTASQTAWALMALLAAGERDSGAVERGVAWLAATQREDGSWDEPYFTGTGFPWDFSINYHLYRQVFPLTALGRYVHGEPFSKKQTAARNGSAQPLAGVKGSR

SEQ ID NO: 227 - protein, 666 aa, Streptomyces griseus
MTATTDGSTGAANPSEATAHDPTDTTTAADDLTVAARRAAERSVEHLLGRQDEQGWWKGDLATNVTMDAEDLLLRQFLSIQDPETTRAAALFIRGEQLGDGTWNTFYGGPGDLSATIEAYVALRLAGDRPDEPHMARAAGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRVAMNLAARWIIERQENDGCWGGIQPPAVYSVIALHLLGYDLDHPVMKAGLASLDRFAVRREDGARMIEACQSPVWDTCLATIALADAGLRPDHPALVKAADWMLAEEITRPGDWSVRKPELAPGGWAFEFHNDNYPDIDDTAEVVLALRRVRHPDPARLQAAIDRGVRWNLGMQSRNGAWGAFDADNTSPFPNRLPFCDFGEVIDPPSADVTGHVVEMLAVEGLASHPRTREGIEWLLAEQEACGAWFGRWGVNYVYGTGSVVPALITAGLPAGHPAIRRAVAWLESVQNDDGGWGEDLRSYQEEKWIGHGESTASQTAWALLALLAAGRRDTRPVARGVTWLTEAQQADGSWDEPYFTGTGFPWDFSINYHLYRQVFPLTALGRYVHGDPFADRAMAAEGA

SEQ ID NO: 228 - protein, 630 aa, Streptomyces hygroscopicus
MLARRATDRAVRHLLSRQDEQGWWKGDLETNVTMDAEDLMLRHFLGIQNPDVLDAAGRYIRSQQAADGTWATFHGGPPELSATVEAYVALRLAGDPPDAPHMAAASAWVRNNGGVASSRVFTRIWLALFGWWRWEDLPELPPEIIYFPPWLPLNLYDFGCWARQTIVPLTVVSAKRPVRPAPFSLDELHADPRRPNPPRPAAPLASWDGAFQRLDRALHLYRKVALRPLRRAALRSCARWIVERQENDGCWGGIQPPAVYSVIALHLLGYDLDHPVMRAGLESLDRFAVWREDGSRMIEACQSPVWDTCLAVIALADAGLAPDHPALVKSADWMLAEEIDRPGDWSVKRPRLAPGGWAFEFDNDNYPDIDDTAEVILALRRVDHPRPERIAAAVRRGVRWTLGMQSRNGAWGAFDVDNTSPLPNRLPFCDFGEVIDPPSADVTAHVVEMLAHEGGARDPRTRRAVGWLLAEQEPSGAWFGRWGTNYVYGTGSVVPALVAAGLPATHPAIRRAVRWLESVQNEDGGWGEDQRSYPDPEWIGHGASTASQTAWALLALLAAGERESKAVERGVGWLAATQDQDGSWDEPYFTGTGFPWDFSINYHLYRLVFPLTALGRYVSGEATGARPRRT

SEQ ID NO: 229 - protein, 680 aa, Streptomyces lividans
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQEADGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKSRAADAPAEAAPAEVKGS

SEQ ID NO: 230 - protein, 674 aa, Streptomyces peucetius
MTATTDGSSGPLRGGAATAGETTSTSAARTTEPGTDLREAAARAAERAVEHLLARQDAEGWWKGDLETNVTMDAEDLLLRQFLGIQDPATVGASARFIRGQQRDDGTWATFYGGPGELSTTVEAYVALRLAGDRPDDPHMQRAASWVRSRGGIAASRVFTRIWLALFGWWKWEDLPELPPELIFLPKWFPLNIYDFGCWARQTIVPLTVVSAKRPVRPAPFALDELHTDPALPNPGKRLAPAASWDGFFQRADKALHAYHKVAPRRLRRAAMNAAARWIIERQENDGCWGGIQPPAVYSVIALHLLGYDLEHPVMRAGLESLDRFAVHHEEEGLPVRMIEACQSPVWDTCLATIALADAGLPADHPALVKAADWMLSEQIVRPGDWSVRRPGLGPGGWAFEFHNDNYPDIDDTAEVVLALRRVKHPDPERVDAAVARGTRWNLGMQSRDGAWGAFDADNTSPFPNRLPFCDFGEVIDPPSADVTAHVVEILAHEGMAHDPRTRRGVRWLLAHQEANGAWFGRWGVNYVYGTGAVVPALTAAGLPGSHPAIRRAVAWLESVQNEDGGWGEDLRSYREEKSIGRGVSTASQTGWALLALLAAGERESKAVERGVAHLAQTQAPDGSWDEPYFTGTGFPWDFSINYHLYRQVFPLTALGRYVHGEKLPGRAGAREGR

SEQ ID NO: 231 - protein, 674 aa, Streptomyces pristinaespiralis
MTATTDGSSGPVRAGAATAGDTTTTTAARTTAPGTDVREAAGRAAERAVEHLLARQDAQGWWKGDLETNVTMDAEDLLLRQFLGIQDAATVEASARFIRGQQRDDGTWATFYGGPGELSTTIEAYVALRLAGDRPDDPHMQRAASWVRSRGGIAAARVFTRIWLALFGWWKWDDLPELPPELILLPKWVPLNIYDFGCWARQTIVPLTVVSAKRPVRPAPFALDELHTDPAMPNPQKRFAPAASWDGFFQRADKALHLYHKVAPRRLRRAAMNAAARWIIERQENDGCWGGIQPPAVYSVIALHLLGYDLEHPVMRAGLESLDRFAVHREEEGLPVRMIEACQSPVWDTCLATIALADAGLPADHPALVKAADWMLSEQIVRPGDWAVRRPGLGPGGWAFEFHNDNYPDIDDTAEVILALRRVKHPDPERVEAAVARGTRWNLGMQSLNGAWGAFDADNTSPFPNRLPFCDFGEVIDPPSADVTAHVVEMLAHEGMAEDPRTRRGVRWLLREQEANGAWFGRWGVNYVYGTGAVVPALIAAGLPASHPSVRRAVTWLESVQNEDGGWGEDLRSYREEQSIGRGASTASQTGWALLALLSAGERDGRAVERGVAWLARTQRPDGSWDEPYFTGTGFPWDFSINYHLYRQVFPLTALGRFLHGEKPVGRAAAREGG

SEQ ID NO: 232 - protein, 664 aa, Streptomyces scabiei
MTATTDGSTGALPPRAPSASDTDHGTPVAAGVQEAALHAVGRATDFLLSRQDAQGWWKGDLETNVTMDAEDLLLRQFLGIRDDATTRAAALFIRGEQRPDGTWATFYGGPPDLSATVEAYVALRLAGDDPAAPHMAKASAWIRARGGIAAARVFTRIWLALFGWWKWDDLPEMPPEIVYFPTWMPLNIYDFGCWARQTIVPLTVVSAKRPVRPAPFPLDELHTDPGRPNPPRPLDRLGSWEGAFQRLDRALHGYHKVALKRLRRAAMNRAARWIVERQENDGCWGGIQPPAVYSVIALHLLGYDLGHPVMRAGLESLDRFAVWREDGARMIEACQSPVWDTCLATIALADAGLPPDHPQLVKAADWMLGEEIVRPGDWSVKRPQLPPGGWAFEFHNDNYPDIDDTAEVVLALRRVRHPDPERVERAVRRGVRWTLGMQSGNGAWAAFDADNTSPFPNRLPFCDFGEVIDPPSADVTAHVVEMLAAEGLSHDPRTRRGIEWLLAEQEPGGAWFGRWGVNYVYGTGSVVPALVTAGLPAAHPAIRRAVAWLETVQNDDGGWGEDLRSYPDPAEWGGKGASTASQTAWALLALLAAGERDGKATERGVAWLARTQREDGSWDEPYFTGTGFPWDFSINYHLYRQVFPLTALGRYVHGEPAVLKPGTR

SEQ ID NO: 233 - protein, 684 aa, Streptomyces sp.
MRRRRSPRGPGAGPEADYGPARASAPDRLRGDAARGDAARRVQDATARAIRNLLGRQDPAGWWKGDLETNVTMDAEDLLLRQFLGIRDEAVTQAAALFIRREQREDGTWATFHGGPPELSATIEAYVALRLAGDAPDAPHMATASAWIRAHGGLAAARVFTRIWLALFGWWDWENLPELPPELVLLPPWVPLNIYDFGCWARQTIVPLTVVSAMRPVRPAPFALDELHTDARVPVPPRRMAPPTTWNGAFQWMDRALHVYRRFAPRRLREAAMASAGRWIIERQENDGCWGGIQPPAVYSVIALHLLGYDLGHPVMRAGLESLDRFAVWREDGSRMIEACQSPVWDTCLAAIALADAGVRPDHPALVKAADWMLGEEIVRTGDWAVRRPGLAPGGWAFEFHNDTYPDIDDTAEVVLALRRIRHPDPARVEAAIARGVSWNLGMQSRGGAWGAFDADNTSPFPNRLPFCDFGEVIDPPSADVTAHVVEMLAAEGRAADPRTRRGIAWLLAEQEPEGPWFGRWGTNYVYGTGSVVPALTAAGLSPGHPAIRRAVLWLESVQNPDGGWGEDQRSYQDRAWAGKGESTPSQTAWALMALLSAGERDAKTVERGIAYLVETQLADGGWDEPHFTGTGFPWDFSINYHLYRHVFPLTALGRYLYGEPFGHDGRHIGAHLGDRTGVPAEGV

SEQ ID NO: 234 - protein, 665 aa, Streptomyces sp.
MHEGEAMTATTDGSTGAATPPATTASAPLHLSPEARETHEATARATRRAVDFLLARQSDEGWWKGDLATNVTMDAEDLLLRQFLGIRDEATTRAAALFIRGEQQEDGTWNTFYGGPGDLSATIEGYVALRLAGDSPEAPHMRKASAFVRAQGGVARARVFTRIWLALFGWWKWEDLPEMPPELMFFPKWAPLNIYDFGCWARQTIVPLTVVCAQRPVRPAPFALEELHTDPADPDPAQPAPPVVSWDNVFHKLDKLLHGYRRIAPRRVREAAMRAAATWIVERQENDGCWGGIQPPAVYSIMALNLLGYDLDHPVLRAGLASLDRFAVWREDGARMIEACQSPVWDTCLATVALADAGVPADHPQMIKAADWMLAEQIVRPGDWVVRRPDLPPGGWAFEFHNDNYPDIDDTAEVVLALRRVAHPDATRVDKAVRRAVDWNVGMQSKNGAWGAFDADNTSPFPNRLPFSDFGEVIDPPSADVTAHVVEMLAEEGLAHHPRTRRGIEWLLKNQEGNGSWFGRWGVNYVYGTGAVVPALVAAGLPASHPAIRRSVSWLGQVQNEDGGWGEDLRSYQDSAWHGRGHSTASQTAWALLALLAAGERETEQVRRGIAYLVETQTEDGTWDEPWFTGTGFPWDFTINYHLYRQVFPVTALGRYLNGTGPGEN

SEQ ID NO: 235 - protein, 636 aa, Streptomyces sp. AA4
MTQTVPRTAASAPAARTAADTVAAAVQFLRREQDRAGWWKGELATNVTMDAEDLLLRHFLGILTPQIAEESARWIRSQQRADGTWANFPDGPADLSTTVEAWVALRLAGDPADAPWLATAAEWIREHGGIEATRVFTRIWLAMVGQWSWDDLPSLPPELIFLPSWFPLNVYDFACWARQTIVPLTIVGTLRPARKLPFDVAELRTGKRPPKPRAPWTWDGVFQNLDTALHAYAKLPLNPVRKLALKQAAEWILARQEADGSWGGIQPPWVYSILALHLLGYSLDHPALKAGIAGLDGFTIREKTDQGWVRRLEACQSPVWDTALAMTALLDAGVSPGDESLVRAAEWMLGEEIRVPGDWAVRRPSLKPGGFAFEFANDGYPDTDDTAEVVLALRRMGKPDHLRIREAVDRSVAWLEGMQSSDGGWGAFDADNTQVLTTRLPFCDFGAVIDPPSADVTAHVVEMLAAEGKADTRECRRGIRWLWDNQEADGSWFGRWGANYVYGTGAVVPALVAAGVPGTDPRIRRAVRWLAEHQNDDGGWGEDLRSYDDRSWAGRGDSTPSQTAWALLALLAAGERESTVVARGVEWLCERQRPDGGWDEDKHTGTGFPGDFYLSYHLYRVVFPLSALGRYVRGGS

SEQ ID NO: 236 - protein, 676 aa, Streptomyces sp. C
MTATTDGGGAITGGADPRHDSTAAPAAAAAGPSGGGTGLPEGVREAVDRATAELLARQDPAGWWKGDLQTNVTMDAEDLLLRQFLGIRDEAVTRAAALFIRGEQQGDGTWATFHGGPPELSATIEAYVALRLAGDPPDAPHMTRASAWIRAHGGIAAARVFTRIWLALFGWWSWDRLPELPPELVFLPPWVPLNIYDFGCWARQTIVPLTVVSALRPVRSAPFALDELHTDARDPVPAKPLPPLASWDGAFQRMDKALHLYRRVAPRRLRKAAMAAAGRWIVERQENDGCWGGIQPPAVYSVIALHLLGYDLGHPVMRAGLESLDRFAVWREDGARMVEACQSPVWDTCLAAIALADAGLPPDHPALVRAADWMLGEEIRRPGDWAVRRPGLAPGGWAFEFHNDNYPDIDDTAEVVLALRRIRHPQPGGVEAAIARGVSWTLGMQSKNGAWGAFDADNTSPFPNRLPFCDFGEVIDPPSADVTAHVVEMLAAEGRAADPRARRGIAWLLAEQEPDGPWFGRWGTNYVYGTGSVVPALTAAGIAPSHPAVRRAVRWLESVQNEDGGWGEDQRSYRDRSWAGKGASTASQTAWALMALLSAGERDGDAVARGLAYLVETQRPDGTWDEPYFTGTGFPWDFSINYHLYRQVFPLTALGRYLHGEPFGPERRNVPPAGES

SEQ ID NO: 237 - protein, 684 aa, Streptomyces sp. Mg1; identical to SEQ ID NO: 233

SEQ ID NO: 238 - protein, 665 aa, Streptomyces sp. SPB74; identical to SEQ ID NO: 234

SEQ ID NO: 239 - protein, 606 aa, Streptomyces sp. SPB78
MDFLLDRQSDEGWWKGDLATNVTMDAEDLLLRQFLGIRDEATTQAAALFIRGEQQEDGTWNTFYGGPGDLSATIEGYVALRLAGDSPEAPHMRKASAFVRARGGVARARVFTRIWLALFGWWKWEDLPEMPPELMFFPKWAPLNIYDFGCWARQTIVPLTVVCAQRPVRPAPFALEELHTDPADPNPAQPAPPVASWDNVFHKLDKMLHGYRKVAPRRVREAAMRAAATWIVERQENDGCWGGIQPPAVYSIIALHLLGYDLDHPVLRAGLESLDRFAVWREDGARMIEACQSPVWDTCLATVALADAGVPADHPQMIRAADWMLAEQIVRPGDWVVRRPDLPPGGWAFEFHNDNYPDIDDTAEVVLALRRVAHPDATRVDKAVRRAVDWNAGMQSKNGAWGAFDADNTSPFPNRLPFSDFGEVIDPPSADVTAHVVEMLAEEGLAHHPRTRRGIEWLLENQEANGSWFGRWGVNYVYGTGAVVPALVAAGIPAAHPAIRRSVSWLGQVQNEDGGWGEDLRSYQDTAWHGRGHSTASQTAWALLALLAAGERDSEQVRRGIAYLVETQTEDGTWDEPWFTGTGFPWDFTINYHLYRQVFPVTALGR

SEQ ID NO: 240 - protein, 669 aa, Streptomyces sviceus
MHEGEAMTATTDGSTGALPPRAAAASETHLDTPVAAGIQEAAVRAVQRATEHLLARQDAEGWWKGDLETNVTMDAEDLLLRQFLGIRDESTTRAAAKFIRGEQREDGTWAGFYGGPGELSTTVEAYVALRLDGDAPDAPHMAKASAWIRAQGGIAAARVFTRIWLALFGWWKWEDLPELPPELIYFPKWAPLNIYDFGCWARQTIVPLTIVSAKRPVRPAPFPLDELHADPADPNPAKPLAPVASWDGAFQRLDKAMHQLRKVAPRRLRRAAMNSAARWIIERQENDGCWGGIQPPAVYSVIALHLLGYDLQHPVMRAGLESLDRFAIWREDGSRMIEACQSPVWDTCLATIALVDAGVPADHPQLVKAADWMLGEEIVRPGDWSVKRPQLPPGGWAFEFHNDNYPDIDDTAEVVLALRRVRHHDPDRVENAIGRGVRWNLGMQSKNGAWGAFDVDNTSPFPNRLPFCDFGEVIDPPSADVTAHVVEMLAVEGLSHDPRTRRGIEWLLAEQEPDGSWFGRWGVNYIYGTGSVVPALTAAGLPASHPAIRRAVAWLEKVQNDDGGWGEDLRSYKYVKEWSGRGASTASQTAWALMALLAAGERDSKAVERGVEWLASTQRADGSWDEPYFTGTGFPWDFSINYHLYRQVFPLTALGRYVHGEPFSRTEAL

SEQ ID NO: 241 - protein, 664 aa, Streptomyces viridochromogenes
MTATTDGSTGALPPRADAASEHDIETPEAAGVREAAVRAARRATDFLLSRQDAQGWWKGDLETNVTMDAEDLMLRQFLGVLDEKTAQAAALFIRGEQREDGTWASFYGGPGELSTTIEAYVALRLAGDAPDSPHLAKASAWIREQGGIAAARVFTRIWLALFGWWKWEDLPELPPELIWFPKWVPLNIYDFGCWARQTIVPLTIVSAKRPVRPAPFPLDELHTDPARPNPPRPLAPAFSWDGAFQRMDKGLHALRKVAPRGLRRAAMNAAARWIIERQENDGCWGGIQPPAVYSIIALHLLGYDLQHPVMREGLASLDRFAVWREDGARMVEACQSPVWDTCLAAIALVDAGLPADHPQLVKAADWMLGEEIVRPGDWSVRRPGLPPGGWAFEFHNDNYPDIDDTAEVILALRRITHHDPVRVDKAVGRGVRWTLGMQSKNGAWAAFDVDNTSPFPNRLPFCDFGEVIDPPSADVTAHVIEMLAVEGLAHDPRTRRGIEWLLAEQEPDGSWFGRWGVNYVYGTGSVVPALVAAGLPGAHPAIRRAVSWLESVQNDDGGWGEDLRSYKYVKEWSGRGASTASQTAWALMALLAAGERDSKAVERGVEWLAATQREDGSWDEPYFTGTGFPWDFSINYHLYRQVFPLTALGRYVHGEPFADRLKGS

SEQ ID NO: 242 - protein, 653 aa, Synechococcus sp.
MSISALQTDRLSQTLTQSVVAAQQHLLSIQNPEGYWWANLESNASITAEVVLLHKIWGTLDSQPLAKLENYLRAQQKTHGGWELYWNDGGELSTSVEAYMGLRLLGVPASDPALVKAKQFILHRGGVSKTRIFTKFHLALIGCYRWQGLPSLPAWVMQLESPFPFSIYELSSWARGSTVPLLIVFDKKPVYPLQPSPTLDELFTESAENVRWELEEKGDWSDAFLWLDKAFKLAESVDLVPFREESIRKAEKWVLERQEPSGDWGGIIPAMLNSMLALRALGYSVSDPVVRRGFQAIDNFMVESETECWAQPCISPVWDTGLAVRSLTDSGLSPNHPALVKAGEWLLDKQILSYGDWSVKNPQGQPGGWAFEFENSFYPDVDDTAVVAMALQDITLPNEPLKRRAIARAVRWIATMQCKTGGWAAFDINNDQDWLNDIPYGDLRAMIDPSTADITGRVLEMHGRFAADLDLANSYAADLSPYRLSRGLNYLIKEQELDGSWFGRWGVNYIYGTGQALSALALIAPERCRIQIERGIAWFVSVQNADGGWGETCESYKDKSLKGKGISTASQTAWALLGLLDVSFCLDPAAKIAVDRGIQYLVSTQSEGTWQEESFTGTGFPQHFYLRYRLYCHYFPLMALGRYQRVINSSAGI

SEQ ID NO: 243 - protein, 653 aa, Synechococcus sp. PCC 7335; identical to SEQ ID NO: 242

SEQ ID NO: 244 - protein, 647 aa, Synechocystis sp.
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 245 - protein, 688 aa, Syntrophobacter fumaroxidans
MNPIRGKRGSAADFLEEEYQWENLADHGESGRTPGGGHPAALKEYEAGSATEHTGHHCVHHLGVRNSWLRKIEKAIDNACGQLFKTQYEDGYWWSELESNVTITSEYIMLLYLLEVSRPEQQKSMVKYLLNQQRPDGSWGLYYGDGGNLSTTIEAYFALKLAGEHCESEPMRRAREFILSKGGIESARVFTKIWLALFSQYDWDKVPSMPVELVLLPSSLYFNIYEFSSWARGTVVPLSIVMSIRPRCPLPAKCSIKELYVPGSKHKNFASCTHKLFFLFDRIAKAFERRPVPSLRNKAVQAAETWVLDHQEDSGDWGGIQPPMVYSVLALYYLGYPLDHEVIVKGIKALDAFCMEDEEGTRMQSCVSPVWDTALTVLSMLDAGVAAEHPGLEKAGRWLLENQVLTGGDWQIKNDSLPGGWAFEFYNTRYPDVDDSAVVLSTLNRFNAERVEGLEFAKCRGMEWCLSMQSSNGGWAAFDKDNTLEILNRIPFADQEAMVDYPTADVTGRVLEAMGYLGYDGSHPRARKAIQFLKKRQERDGCWWGRWGVNYIYGTWSVLKGLISIGEDPRAAYIRAAVRWVKDHQNSDGGWGETCESYENPELRGQGPSTPSQTAWALMSLIACGEMKSQEASRGIQYLLRTQKRDGTWEELHFTGTGFPKHFYIRYHNYRNCFPLMALGQYLRALER

SEQ ID NO: 246 - protein, 710 aa, Syntrophobacter fumaroxidans
MRRLDTFPPEIPTGSRDKPPSGEEHSCSTPAEPLRSRLDEGILRAVDWLVCDQHPDGFWAGMLQSNSCMEAEWVLAMHFLGIDDDPKYDGVIRAILGEQRADGSWGVFHKAPNGDINTTVECYAALRASGLAPESAPLSSAREWILAGGGLANIRNFTKYWLALIGEWPWEGTPTIPPELIFFPPRMPLNIYHFASWARSTIVPLSILSARRPVRPLPEDRRLDELFPQGRSAFDFRLPRKDGWLSWEGFFHVCDRILRLYARTRRAPFRETAIRVCLEWIIRRQETDGAWSGIQPPWIYALLALHAEGYGLDHPILRAGLRAFDSHWSYERDGGIYLQASESPVWDTVLSLRALADCGEERKASVSIASALEWLLNRQISVPGDWAVRVPSVPCGGWAFQRANSFYPDVDDTAVAIEVLARLRPFTANQSAVDRAIRSARDWVLAMQCSNGGWAAFDRDNDFKLVTKIPFCDFGELLDPPSVDVTAHVIEALAALGWDMTSREIEAAVSFIRREQEAEGSWFGRWGVNHIYGTATVLPALRAIGEDMSSAYVLRAADWLASRQNADGGWGETPASYMDDSLRGVGESTASQTAWAIMGLVAVGSGAHDDTVRRGIDFLLFAQHGGTWEEPQYTGTGFPGYSVGERIRLRDMGASLKQGTELQRAFMINYNLYRHYFPLMALGRARYHLQLRRSAREGGNGETTPNGSAL

SEQ ID NO: 247 - protein, 671 aa, Teredinibacter turnerae
MEIQDEVDLLEPQESLTASADSAVDRALFWLLDAQYEDGYWAGILESNACMEAEWLLCFHVLGIANHPMSRGLVQGLLQRQRADGSWDVYYGARAGDINTTVEVYAALRCQGYAADHPDIKRARDWIQLQGGVKQVRVFTRFWLALIGEWPWEETPNLPPEILFFPRWFPFNIYHFAAWARATLVPLCILSARRMVVPLNKKSCLQELFPEDRSAVVALGKKAGAWSTFFYHADRALKKYQRTFKRPPGRQQAIKMCLEWILRRQDADGAWGGIQPPWIYSLMALKAEGYPVTHPVMAKGLAALDAHWSYERPGGARFVQACESPVWDTLLSSFALLDCGFSCTSSSELRKAVDWILDQQVLLPGDWQQKLPTVSPGGWAFERANVHYPDVDDTAVALIVLAKVRPDYPDTARVNLAIERGLNWLFAMQCRNGGWGAFDKDNDKDLLTKIPFSDFGETIDPASVDVTAHVLEALGLLGYRTTHPAVAKALEFIRSEQENDGCWFGRWGVNYIYGTAAVLPALASLNMNMNQEFIRRAANWILGKQNNDGGWGESCASYMDDTQRGRGPSTASQTAWAMMSLLAVDGGTYAESLLRAEAYLKTTQTPEGTWDEPYYTGTGFPGYGIGRREIKRQRSLQQHAELSRGFMINYNLYRHYFPLMALGRLAALRGA

SEQ ID NO: 248 - protein, 642 aa, Thermosynechococcus elongatus
MPTSLATAIDPKQLQQAIRASQDFLFSQQYAEGYWWAELESNVTMTAEVILLHKIWGTEQRLPLAKAEQYLRNHQRDHGGWELFYGDGGDLSTSVEAYMGLRLLGVPETDPALVKARQFILARGGISKTRIFTKLHLALIGCYDWRGIPSLPPWIMLLPEGSPFTIYEMSSWARSSTVPLLIVMDRKPVYGMDPPITLDELYSEGRANVVWELPRQGDWRDVFIGLDRVFKLFETLNIHPLREQGLKAAEEWVLERQEASGDWGGIIPAMLNSLLALRALDYAVDDPIVQRGMAAVDRFAIETETEYRVQPCVSPVWDTALVMRAMVDSGVAPDHPALVKAGEWLLSKQILDYGDWHIKNKKGRPGGWAFEFENRFYPDVDDTAVVVMALHAVTLPNENLKRRAIERAVAWIASMQCRPGGWAAFDVDNDQDWLNGIPYGDLKAMIDPNTADVTARVLEMVGRCQLAFDRVALDRALAYLRNEQEPEGCWFGRWGVNYLYGTSGVLTALSLVAPRYDRWRIRRAAEWLMQCQNADGGWGETCWSYHDPSLKGKGDSTASQTAWAIIGLLAAGDATGDYATEAIERGIAYLLETQRPDGTWHEDYFTGTGFPCHFYLKYHYYQQHFPLTALGRYARWRNLLAT

SEQ ID NO: 249 - protein, 632 aa, Trichodesmium erythraeum
MIEKNKVKQSILASQKHLLSLQETEGYWWGQLESNVTITAEIILLHKIWQTDKKIPLNKAKNYLISQQREHGGWELFYGDGGDLSTSIEAYMALRLLGVSRTDPIMIEAQNFIIKKGGISCSRIFTKLHLALIGCYSWQGIPSIPSSIMLLPEDFPFTIYEMSSWARSSTVPLLIVFDKKPIFSVNPTINLDELYAEGINNASFELPRKYDLTDLFLGLDKAFKFAENLNLMPLQQEGLKAAEKWILERQEVTGDWGGIIPAMLNSMLALKCLEYDVADPVVVRGLEAIDRFAIENEDSYRVQACVSPVWDTAWVIRSLVDSGISPSHPAMVKAGQWLLQQQILDYGDWVFKNKFGKPGGWAFEFMNRFYPDIDDTAVVVMALDVVELPDEDLKGKAIARGMEWIASMQCEAGGWAAFDVDNNQDWLNATPYGDLKAMIDPNTADVTGRVLEMVGCCGLAMDSWRVKRGIDFLVREQEEEGCWFGRWGVNYIYGTSGVILALAVMARESHRGYIERGASWLVGCQNSDGGWGESCWSYNDPSLKGKGKSTASQTAWALIGLLAAGEGTGNFARDAIDGGVGFLVSTQNDDGSWLEDEFTGTGFPGHFYIKYHFYSQYFPLMALGRYESLLSG

SEQ ID NO: 250 - protein, 233 aa, Unknown
  uncultured organism
SPMWDTVLTTLAVQDAGVDQEPEFKPAMERTLEWLLKNEVRTGGDWQQKTRGVEPGGWAFEYANASYPDNDDTAVALIVLAPFRHDPKWQARGIQHVIDRAVNWMFAMQCDNGGWAAFDLDNDKAILTRIPFCDFGEALDPPSVDVTAHVLEALAALGYSREHPAVRRAIAFLKEDQEPDGSWFGRWGVNFIYGTAAALPALKAMDEDMTQDWITRAADWMRSRQNDDGGWGE

SEQ ID NO: 251 - protein, 233 aa, Unknown
  uncultured organism
SPVWDTVLTMLSVQDCDADENSENAPAIEKAIEWLLANEVRTGGDWQEKVKGVEPGGWAFEYKNASYPDTDDTAVAMMALAPYRTEEKWKKKGLPEALKRAAEWNIAMQCSNGGWGAFDKDNDKTILCKIPFCDFGEALDPPSVDVTAHVLEGLAALDYPPEHPAIQRAVQFIKDEQEPDGSWWGRWGVNFIYGTAAALPALKAVGEDMRAPYIDRAAKWIVDHQNEDGGWGE

SEQ ID NO: 252 - protein, 231 aa, Unknown
  uncultured organism
SPVWDTVLTLLALDDCGYNDCYSEEVDKAVQWVLDQQVLSKGDWSVKLPNVEPGGWAFEYANTRYPDTDDTAVALIVLSQFKDDPKWKERGINQAIERGVNWLFEMQCKNGGWGAFDKDNDKTLLTKIPFCDFGEALDPPSVDVTAHIVEAFGKLGYSKDHPKIAHAIEYLKEEQEADGAWFGRWGVNYVYGTGAVLPALEAIGEDMSQPYIRKAANWLVLHQNEDGGWGE

SEQ ID NO: 253 - protein, 231 aa, Unknown
  uncultured organism
SPVWDTVLTLLAFDDCDKNEAYQASVEKAVQWTLDNQVLRKGDWSVKLPDVEPGGWAFEYANTFYPDTDDTAVALIVLSQFRDVEKWQEAGIEKAIERGVNWLFAMQSKNGGWGAFDKDNDNNFITKIPFCDFGEALDPPSVDVTAHCIEAFGKLGLSRARPEIARGLDYLKSEQEADGAWFGRWGVNYVYGTGAVLPALEAIGEDMSQPYIRKAANWLILRQNEDGGWGE

SEQ ID NO: 254 - protein, 231 aa, Unknown
  uncultured organism
  misc_feature (36)..(36): Xaa can be any naturally occurring amino acid
SPVWDTLLTLLAYDDSGQNERKADEVEKAVDWVLAXQVLRPGDWKVKAPNLEPGGWAFEYANYFYPDTDDTAVALIVLSQFRNDAAWKEKGIEQAIEKGVNWLFGMQCKGGGWGAFDKDNDKQFLTKIPFCDFGEALDPPSVDVTAHIVEAFGKLKFSKDHPNIRRAIDYMKDEQEADGAWFGRWGVNYIYGTGAVLPALEAIGEDMFAPCIGRACDWLVSRQNDDGGWGE

SEQ ID NO: 255 - protein, 231 aa, Unknown
  uncultured organism
SPVWDTLLTLLAYDNSGHNARKASEVEKAVDWVLAQQVLRPGDWNVKAPNLEPGGWAFEYANYFYPDTDDTAVALIVLSQFRNDAAWKDKGIEQAIEKGVNWLFGMQCKGGGWGAFDKDNDRQFLTKIPFCDFGEALDPPSVDVTAHIVEAFGKLKFSKDHPNIRRAIDYTKDEQEDDGAWFGRWGVNYIYGTGAVLLALEAIGEDMSAPYIGRACDWLVSRQNDDGGWGE

SEQ ID NO: 256 - protein, 231 aa, Unknown
  uncultured organism
  misc_feature (180)..(180): Xaa can be any naturally occurring amino acid
SPVWDTLLTLLAIEDSGQSVKRAQEVEKAVDWVLSQQVLRPGDWKVRAPHLEPGGWAFEYANYFFPDTDDTAVALIVLSQFRNDAAWKAKGIETAIEKGVNWLLGMQCKGGGWGAFDKDNDKTYLTKIPFCDFGEALDPPSVDVTAHIVEAFGKLGFSKDHPNIARAIEYLKSEQESDGXWFGRWGVNYVYGVGAVLPALEAIGEDMSAPYIGRACDWLVSKQNSDGGWGE

SEQ ID NO: 257 - protein, 231 aa, Unknown
  uncultured organism
  misc_feature (7)..(7): Xaa can be any naturally occurring amino acid
SPVWDTXLTLLALDDCDLNERQSKEVEKAVQWVLNQQVLRPGDWCVKVPKVQPGGWAFEYKNYFYPDTDDTAVALIVLSQFRDDPKWQEKNIEQAIDRGLNWLIGMQCKGGGWGAFDKDNDKTYLTKIPFCDFGEALDSPSVDVTAHIVEAFGKLGLGKSHPAMIRAIDYLKAEQEQDGAWFGRWGVNYIYGTGAVLPALEAIGEDMRAPYIAKACDWLIAVQQEDGGWGE

SEQ ID NO: 258 - protein, 231 aa, Unknown
  uncultured organism
SPVWDTVLTMLAIHDCGADKQYAPQMDKAIDWLLANEVRHKGDWAVKLPDVEPGGWAFEYSNACYPDLDDTAVALIVLAPYRNDPKWQARDIEGAVERAVDWTLAMQCKNGGWGAFGKDNDKAILTKIPFCDFGEALDPPSVDVTAHVLEALAALGYDNSHPAVARAIRYLRDEQEPDGSWWGRWGVNYIYGTAAVLPALKAMGVDMNEPFVHKAADWIGSVQNEDGGWGE

SEQ ID NO: 259 - protein, 231 aa, Unknown
  uncultured organism
SPVWDTVLTLLAMEDCEATEEHAAAIEQAIEWLLENEVRTPGDWQMKVPDADPGGWAFEYANAAYPDVDDTAVAILVLARYRDDPKWQAKGLPQAIDRAVAWVLAMQCSNGGWAAFDKDNDKSILCKIPFCDFGEALDPATVDVTAHVLEALAAVGYGPDHPAVRRGLDFLYAEQEADGSWWGRWGVNYVYGTGAALPAFKAIGADMRDPRMLKAADWILRCQNKDGGWGE

SEQ ID NO: 260 - protein, 231 aa, Unknown
  uncultured organism
  misc_feature (133)..(133): Xaa can be any naturally occurring amino acid
SPVWDTVLTLLAIQDADKQDDMAAEVDRAIGWLLSKEVRTNGDWSVKLPDVEPGGWAFEHENARYPDTDDTAVAVMVLAPYRHHPKWRKRGLPEALDRAISWMRAMQCRNGGWGAFDKDNDNAFLCVIPFCDXGEALDPPSIDVTAHALEAFAAMGFGPEDTTVARALDYMSKEQEADGSWWGRWGVNYIYGTAAALPAYKAFGQDMRDPKLMKAADYLRAKQNADGGWGE

SEQ ID NO: 261 - protein, 231 aa, Unknown
  uncultured organism
SPVWDTVLTLLAIQDADKQEEMAGEIDKAIGWLLSKEVRTKGDWSVKLPRVEPGGWAFEHENARYPDIDDTAVAIMVLAPYRDHPKWKKRGLPEALDRAIAWMRAMQCRGGGWGAFDKDNDKQILCTIPFCDFGEALDPPSIDVTAYALEAFAAMGYGPDDKTVARALKYMSKEQEADGSWWGRWGVNYIYGTAAALPAYKALGQDMRDPGLMKAADYLRDKQNADGGWGE

SEQ ID NO: 262 - protein, 231 aa, Unknown
  uncultured organism
SPVWDTVLTLLAMQDADRTDKHKAAVDKAIQWVLDQEVRTPGDWCVQTPDVEPGGWAFEYENARYPDVDDTAVAIMVLAPYQDDPKWRKRGLPDALARAIAWIRAMQCKNGGWGAFDRDNDNSMLTVIPFCDFGEALDPPSVDVTAHALEAFHMMGYGPEDPTVARALAYLDAEQEQDGSWWGRWGVNFIYGTSAALPALKAMGRDMRDPRYTKAADYLRAVQNDDGGWGE

SEQ ID NO: 263 - protein, 231 aa, Unknown
  uncultured organism
SPVWDTSLILNALLAGSEKTETDPKILKAGQWLLDREVREIGDWKIKNNRGPVGGWYFEYANEFYPDCDDTAEVITVLNQMQFSDPEKEKAKQVAQQRGLDWLLSMQNKDGGWPAFDKNCDKQSLTYMPFADHNAMIDPSYEDITGRTLEALASLGFSEDDPIVRRAVDFLKSKQLPDGTWYGRWGCNFLYGTWLAISGLYHAGEDLNEERYQSLLSWLEQCQNEDGGWGE

SEQ ID NO: 264 - protein, 230 aa, Unknown
  uncultured organism
SPVWDTLLTLEALLDCNLSPKTFTGMQAAVDWILSKQIVTPGDWQIKVPGVSCGGWAFERANTFYPDMDDTAVAMIVLARIRRYYNDSSRIDRALACATDWILSMQCSNGGWAAFDLDNTNDLVTRIPFSDFGEMLDPPSVDVTAHVVEALGCLGRTRNDPAVARAVAYILDEQEPEGSWFGRWGVNHIYGTGAVLPALAAVGTDMSAGYITRAADWVATHQNADGGWGE

SEQ ID NO: 265 - protein, 230 aa, Unknown
  uncultured organism
SPVWDTTNAMTAVLDAGLPGNHPAVLRAARWLLSKEVRMPGDWRLWYKNGEPGGWFFEYNNEFYPDADDTAEALHCLCRVVFDCEDEMDRCRAAIKRGLNWQFACQNPDGGWPAFDKECDDEYLTFIPFADHNAMIDPSCCDITGRSLQALSKLGYTTNDVDVKRAIDYLLDAQEDDGTWYGRWGINYIYGTWLAVQGLRAIGVDLSEKRFQKVTKWLRKKQNPDGGWGE

SEQ ID NO: 266 - protein, 230 aa, Unknown
  uncultured organism
  misc_feature (208)..(208): Xaa can be any naturally occurring amino acid
  misc_feature (224)..(224): Xaa can be any naturally occurring amino acid
SPIWDTGIVLHSLVESGVSPDHEALLRSVSWLLAKEVTHEGDWKVKCPDAPVGGWYFEYANEFNPDCDDTAKVLMATSRFSSVDFPDAGRLRDARNRGLQWLLHMQNKDGGWAAFDKGCDNELLTYIPFADHNAMIDPSTEDITGRVLETLAREGFDNTHPVVKRAIQYLHKTQDAEGPWYGRWGSNFIYGTWLVLQGLKAVGEDMTXPRYQRAANWLLNVQNXNGSWGE

SEQ ID NO: 267 - protein, 230 aa, Unknown
  uncultured organism
SPVWDTAISVIALAESGLHRGHPSLVQATEWLVANEIRRGGDWQVKNPTAPISGWAFEFKNDFYPDVDDTAMVLLALRHVHLYNDDVSQDREKSYLRGLNWMLSMQCKNGGWAAFDRDNVKTIFEKIPFADHNAMIDPPSVDITGRVLELLGYVGYDKSYPCVTKALEYIKKDQEADGSWYGRWGVNYIYGTWQVLRGLAAIGEDMQSEYVQKAVRWMKSVQNPDGGWGE

SEQ ID NO: 268 - protein, 229 aa, Unknown
  uncultured organism
  misc_feature (111)..(111): Xaa can be any naturally occurring amino acid
SPVWDTCLILNSMLEHLEPDHPRVQKAAEWLLSKEVTEPGDWQVKCPEAPVGGWYFEYANEFYPDCDDTAEVLAALQRVQFTDADREAQKRGAIQRGLGWLLAMQNQDGGXAAFDRECTREALTYVPFADHNAMIDPSNGDITGRVLKALDYAGYSPDDPIVRGGVDFLLANQEPDGTWYGRWGCNHLYGSWLVVWGLKHAGVNLQQTQFTQVMSWLESCQNADGGWGE

SEQ ID NO: 269 - protein, 229 aa, Unknown
  uncultured organism
SPVWDTCLILNSLLEHLEPDHPRLQHAAEWLLSKEVTEPGDWQVKCPEAPIGGWYFEYANEFYPDCDDTAEVLAALQRVRFSDADREAQKHAAIERGLGWLLAMQNGDGGWAAFDRECTREALTYVPFADHNAMIDPSNGDITGRVLKALDYSGRSPQDPVVQGGVHFLLANQEPDGTWYGRWGCNHLYGSWLAIWGLKHAGVDSQQSQFMRLLSWLESCQNPDGGWGE

SEQ ID NO: 270 - protein, 229 aa, Unknown
  uncultured organism
SPVWDTALAMSALLEGDTAPDDEALQRGCRWLLGKEVRHRGDWQVNVGAEPGGWFFEYENEFYPDCDDTAEVLAVLERVRLSDPEEDQRRRDALDRALAWQLGMQSTNGGWGAFDKDCDHRILELVPFADHNAMIDPPTVDVTSRSIEAALAMGVPASDAAIRRAVRFLYSEQEADGSWYGRWGSNYLYGTWLALCALRSAGEDLTSPAVQRAVEWLLSVQQEDGGWGE

SEQ ID NO: 271 - protein, 295 aa, Unknown
  uncultured organism
  misc_feature (15)..(15): Xaa can be any naturally occurring amino acid
  misc_feature (30)..(30): Xaa can be any naturally occurring amino acid
SPVWDTAISVISLAXSGMERGHPALVRAAXWLMSKEIKTAGDWKVTNPAGPVGGWAFEFNNAFYPDIDDSAMVMMALRHVHLDEHTAHRREKACLRGLNWLLSMQSRTGGWAAFDKDNTKVIMTKIPFADHNAMIDPPWADITGRVLEFLGYIGYDQSYPAVARAARFLREEQEEDGSWFGRWGVNYIYGTWQVLRGLAAIDEDMSQPYIRRAAEWLRSVQPPDGGWGETCATYHDPSLKGKGPATPAQTAWAVMGLMAAGIYDESVSRGIDYLVRTQRPDGTWDETEYTGTGFP

SEQ ID NO: 272 - protein, 231 aa, Unknown
  uncultured organism
SPVWDTGLVALALQEVDKHNSQDALQRNLKQAYSWLLSKQLKDEPGDWRISKPTLTGGGWAFQFNNPHYPDVDDTAVVAFALAQAEHTELDESIHLATRWIEGMQSQNGGYGAFDVDNTFYYLNEIPFADHGALLDPPTADVSARCAMLMARVAKDHEEYLPALERTIQYLRSEQEADGSWFGRWGTNYVYGTWSVLLGLEQTNVPKTDPLFTKAAQWLKSVQRPDGGWGE

SEQ ID NO: 273 - protein, 231 aa, Unknown
  uncultured organism
SPVWDTGLVALALPEVDKHNSQDALQPNLKQAYSWLLSKQLKDQPGDWRISKPTLTGGGWAFQFNNPHYPDVHDTAVLAFALAQAEHTELDESIHLATRWIEGMQSQNGGYGAFDVDNTFYYLNEIPFADHGALLDPPTADVSARCAMLMARVAKGHEEYLPALERTIQYLRSEQEADGSWFGRWGTNYVYGTWSVLLGLEQTNVPKTDPLFTKAAQWLKSVQRPDGGWGE

SEQ ID NO: 274 - protein, 232 aa, Unknown
  uncultured organism
SPVWDTILSMQALLDTKEVFQPSPTLKKAMEWLLEQQVRAWGDWKVYVSDARGGGWAFQRANSFYPDVDDTIMVMMALRNVSPRGESKVVDEAIERALFWVLGMQCEDGGWAAFDRDNAKAFLTKVPFADHNAMIDPSTADLTSRTFEMFAMIAPEVFTIHHPVVRRGLEFLKKDQCKDGSWFGRWGVNYMYGTWQVLRGLRLIGEDMSKGYVRKGVEWFKSVQLEDGGWGE

SEQ ID NO: 275 - protein, 228 aa, Unknown
  uncultured organism
SPVWDTLLALLALQDCDRELTAEMSRALDWVLANEVRYHGDWTKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLLGFDRRHPAVERGLRFLRSEQEADGSWFGRWGVNYVYGTAAVLPGLAAIGEDMTQDYIRRANDWLIAHQNPDGGWGE

SEQ ID NO: 276 - protein, 204 aa, Unknown
  uncultured organism
  misc_feature (201)..(201): Xaa can be any naturally occurring amino acid
SPVWDTLLTLLAMEDCDRGLTPSMQRALEWVLAQEVRYAGDWSKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLPGFDRRHPAVERGYKFLRSEQEADGSWFGRWGVNHIYGTAAVLPALASIXEDM

SEQ ID NO: 277 - protein, 228 aa, Unknown
  uncultured organism
SPVWDTLLALLAMQDCERELTPQMERALDWVLANEVRYYGDWSKKVRGVEPSGWAFERANLNYPDIDDTVVALIVLARLPRALLDQPRIRAVIDRALGWTLAMQSSNGGWAAFDKDNDHLIITKIPFCGFGEALDPPSADVTAHVLEALGLLGFDRHHPAVARGYQFLRKEQEADGSWFGRWGVNHIYGTAAVLPALAAIGEDMSQPYIRAAAEWIIAHQNADGGWGE

SEQ ID NO: 278 - protein, 204 aa, Unknown
  uncultured organism
  misc_feature (198)..(198): Xaa can be any naturally occurring amino acid
SPVWDTLLSLLAMQDCERGFTPSMERALDWVLANEVRYYGDWSKKVRGVEPSGWAFERANLNYPDIDDTAVALIVLARLPRAQLDQPRIREVIDRALGWTLAMQSSNGGWAAFDKDNDHLIITKIPFCDFGEALDPPSADVAAHVLEALGLLGFERKHPAVERGLKFIRSEQEADGSWFGRWGVNHIYGTAAVLPALXAIGEDM

SEQ ID NO: 279 - protein, 228 aa, Unknown
  uncultured organism
  misc_feature (9)..(9): Xaa can be any naturally occurring amino acid
  misc_feature (31)..(32): Xaa can be any naturally occurring amino acid
  misc_feature (57)..(57): Xaa can be any naturally occurring amino acid
  misc_feature (102)..(102): Xaa can be any naturally occurring amino acid
  misc_feature (131)..(131): Xaa can be any naturally occurring amino acid
  misc_feature (191)..(191): Xaa can be any naturally occurring amino acid
SPVWDTLLXLLAMQDCERESTPSMERALDWXXANEVRYYGDWSKKVRGVEPSGWAFXRANLNYPDIDDTDVALIVLARLPRALLDQSRVHAVIDRALGWTLXMQSSNGGWAAFDKDNNHLIITKIPFCDFXEALDPPSADVTAHVLEALGLLGFNRNHPAVERGYRFLRSEQETDGSWFGRWGVNHVYGTXAVLPALAAIGEDMTQPYIRSAAEWIIAHQNADGGWGE

SEQ ID NO: 280 - protein, 228 aa, Unknown
  uncultured organism
SPVWDTLLSLVALQDCGKELTPARERALEWILGREIRTRGDWAKKVKNVEASGWAFERANLHYPDIDDTAVALIMLARLPRAWLDQPRIRAVIDRALGWTLAMQSSSGGWAAFDKDNDRLIITKIPFCDFGEALDPPSADVTAHVLEALGILGFDRQHAAVRHGLKFLRSEQEADGSWFGRWGVNHVYGTGAVLPALAAIGEDMAQDYVRRAADWLVAHQNADGGWGE

SEQ ID NO: 281 - protein, 228 aa, Unknown
  uncultured organism
SPVWDTLLTLLAYQDCELEMNDSAGRALDWILSQENSYRGDWAHRNKKLEPSGWAFERANLHYPDIDDTSVALIVLARLPQAVRSRPDIKSAIDRALAWTLGMQCRNGGWAAFDRDNDKLIITMIPFCDFSEALDPPSADVTAHVVEAMAHLGFDRSHKAVEKAYQYLLAEQEDDGSWFGRWGVNHIYGTAAVLPALAALGEDATVPHVKRAADWISAHQNTDGGWGE

SEQ ID NO: 282 - protein, 228 aa, Unknown
  uncultured organism
SPMWDTSLAAHALMEADGRGDPKDNPRLISAMDWLADKQILDHVGDWAVRRPDVRPGGWAFQYENPDYPDVDDTAVVVMAMHRADPERYEMSIDRACEWLVGMQSKNGGWGAFEPENEHYYLNSIPFADHGALLDPPTVDVTARCVGALAQVDRDRYAAEIANGIRSIRREQEDDGSWFGRWGANYVYGTWSALVALKGAGEDMQQPYIRRAVDWLKARQRSDGGWGE

SEQ ID NO: 283 - protein, 228 aa, Unknown
  uncultured organism
SPVWDTCLTSNALVESGGDTSAPHVHRSVQWLLNQEIRNHGDWSVKAPKVGPSGWAFEFANKVYPDVDDAAEVIIALANYSNDSGTAPPDAIARGVRWISGMQSSNGGWGSFDKNNTSFFVTRLPFFDFGEVIDPPSVDVTAHVIEALAVAGWQEKASKQIQKALDYIWSEQEADGPWFGRWGINYIYGTCAVLSALEAIGYDMADARVVKALKWIEECQNADGGWGE

SEQ ID NO: 284 - protein, 228 aa, Unknown
  uncultured organism
SPVWDTVAQLHALIASGLARRDEALRRAASWLLTRQSRTHGDWSGRNPAEPGGFYFEFRNEFYPDVDDTAMALMVLTQAEANVATDVQHAAIARALAWMLGMQNRDGGWAAFDRDNDKHFLTQVPFADHNAMIDPSTADITGRVLGALSHVPSYGPDHPSVRRAIAFLQRDQEPDGSWYGRWGVNYLYGTGQVLRGLRAIGFDMQQPFVRRAARFLSAHQNDDGGWGE

SEQ ID NO: 285 - protein, 227 aa, Unknown
  uncultured organism
SPVWDTAITIIALAESGLPKNHPAFEQAATWLEKKEIRFKGDWAVRMPGVEPSGWAFEHENKYYPDTDDTMMVLMALRHVQSRNSAERCEQFDRALKWLLAFQCQDGGWAAFDKDVTASWLEHVPFADHNAILDPTCSDLTARVLELLGSISFDRQSAIVRRAVAMMRRTQETDGSWYGRWGVNYIYGTWQALRGLAAIGENMDQEWIRRGRDWLESCQNDDGGWGE

SEQ ID NO: 286 - protein, 227 aa, Unknown
  uncultured organism
SPVWDTAINVISLAESGLLSDHPALQKAADWLVNKEVRFRGDWSVNNSYPQVSGWAFEYNNVYYPDTDDTAMVLMALRLIRPKDPQALNELFRRALDWQLSFQCRDGGWAAFDKNVTTPWLEDMPFADHNAILDPTCSDLTARTLELLGYTGFDPKAQSVRDALQYLIDTQDEDGSWYGRWGVNYIYGTWQVLRGLRAMGQDMTQDWILRGRDWLESCQNSDGGWGE

SEQ ID NO: 287 - protein, 227 aa, Unknown
  uncultured organism
SPVWDTAITSVALTSSGVKPDHPQIQKAADWLLDREVVMRGDWKVKNPYPHASGWAFEFNNDFYPDADDTFKVLLALMKMKSSDPERQRKIMDRALDWARSFQCKDGGFAAFDKDVTKKWLEHVPFADHNAILDPSCSDITARGLECMGKLGWPRTDRVIRRAIRYLKKTQEEDGSWWGRWGVNYIYGTWQSLRGLEAIGEDMNQDWVVRARNWLESCQNPDGGWGE

SEQ ID NO: 288 - protein, 227 aa, Unknown
  uncultured organism
SPVWDTAITAVSLAESGLEPDHPALQKSAEWLLDKEVRIQGDWAIKNRHGEASGWAFEFNNEFYPDVDDTLKVLLALRLIKTRDEETKREAMERALGWVMSFQCSDGGWAAFDKDVTQRWLEDVPFADHNAILDPTCSDITARCLELLGKMGCTSDHPAVRRALRMVRETQEPDGTWWGRWGVNYIYGTWQILRGLSALKIDMNQDWIVRAKEWLESCQNPDGGWGE

SEQ ID NO: 289 - protein, 227 aa, Unknown
  uncultured organism
SPIWDTAIVTMAIAESGQDPNDPRLQKAADWLLEREIGFRGDWRENCDFPEATGWAFEFNNDWYPDVDDTFQVILGLKPLSASDSRRQEQTLDRAIRWCRAMQCREGGFAAFDKDINDAWLNEVPFADHNAILDPPCSDITGRALETLSLMGFDREDPVVRRARQYLMETQLEDGSWFGRWGVNYIYGTGHALRGLHAIGEDINGSAMQRARNWLENCQNDDGGWGE

SEQ ID NO: 290 - protein, 231 aa, Unknown
  uncultured organism
SPIWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPGVRKDADVQRVIEKGIEYLKKTQEPDGSWYGRWGVNYIYGTWQSLKGLAAVGEDPSQPYIQKAAHFLKTHQNSDGGWGE

SEQ ID NO: 291 - protein, 231 aa, Unknown
  uncultured organism
SPMWDTAKAVNALHESGLPSDHPQLKAAARWLVEKEVQKPGDWKMRVPYVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDVDVQRVIEKGIEYLKKTQEPDGSWYGRWGVNYIYGTWQSLKGLAAVGEDPSQPYIQKAAHFLKTHQNSDGGWGE

SEQ ID NO: 292 - protein, 231 aa, Unknown
  uncultured organism
SPVWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDANVQNVIAKGIEYLKKTQEPDGSWYGRWGVNYIYGTWQSLKGLAAVGEDPSQPYIQKAAHFLKTHQNSDGGWGE

SEQ ID NO: 293 - protein, 227 aa, Unknown
  uncultured organism
SPVWDTCLSLAALTEAGAQNDHPAVKQAVEWLLDHQIFVEGDWCAQASGLEPGGWAFQYENDKYPDVDDTGMVLMSLLRAGVHDKEHKRKRVNQALNWVLGMQNPDGSWGAFDIENNYEYLNKIPFADHGALVDPGTADLTARCVELLAMLGYDATFPPVKRALEFLEHDQEEDGSWYGRWGVNYIYGTWSVLCALGAIGEDVAKPYVRKSVQWLQDTQNEDGGWGE

SEQ ID NO: 294 - protein, 227 aa, Unknown
  uncultured organism
SPVWDTCLSLAALTEAGAQNDHPAVKQAVEWLLDHQIFVEGDWCDQAPGLEPGGWAFQYENNKYPDVDDTGMVLMSLLRAGVHDKEHKRKRVNQALNWVLGMQNPDGSWGAFDIENNYEYLNRIPFADHGALVDPGTADLTARCVELLAMLGYDATFPPVKRALEFLEQDQEEDGSWYGRWGVNYIYGTWSVLCALGATGEDVAKPYVRKSVQWLQDTQNEDGGWGE

SEQ ID NO: 295 - protein, 227 aa, Unknown
  uncultured organism
SPVWDTCLSLTAMTESGAHPEHPAVKQAVEWLLDQQIFVKGDWADQAKNLEPGGWAFQFENDRCPDVDDTGMVLMALLRAGVQDKEHKIKRINQAVNWVLGMQNPDGSWGAFDIGNDHEYLNNIPFADHGALVDPGTADLTARCVELLAMLGYGPDFPPIQRAVAFLERDQEEFGAWYGRWGVNYIYGTWSVLSAIGILGEDYAKPYVRKAVEWLKEIQNDDGGWGE

SEQ ID NO: 296 - protein, 227 aa, Unknown
  uncultured organism
SPVWDTCLSLNALTEADMPANDPRVRAAVQWLFDRQIFVRGDWSENAPELEPGGWAFQYENDKYPDVDDTGMVLMSLLRANAHEHDAQRKRMNQALNWVLGMQNSDGSWGAFDIDNHYTYLNNIPFADHGALVDPGTADLTGRCIELFGMLGYDKNFTPARRGIEFLKRDQHPCGGWYGRWGVNYLYGTWSVLTALGAIGEARDAPYLRRAVEWLYSVQNDDGGWGE

SEQ ID NO: 297 - protein, 227 aa, Unknown
  uncultured organism
SPVWDTALVLQAMQEASIPLDHPALVKAAQWLLDREVRIKGDWKIKSPGLEPGGWAFEFQNDWYPDVDDSAAVLIAIKDIQVKNNKAKQGAVRRGIDWCLGMQSKNGGWGAFDKDNTKHLLNKIPFADLEALIDPPTADLTGRMLELMGNFGYDKHHPQAVHALEFLKKEQEPEGPWFGRWGVNYIYGTWYVLIGLEAIGEDMNQPYIKKAANWIKSRQNIDGGWGE

SEQ ID NO: 298 - protein, 227 aa, Unknown
  uncultured organism
  misc_feature (78)..(78): Xaa can be any naturally occurring amino acid
SPVWDTTLVLVAMQEAGVPVDHPALVKSAQWLLDLEVRRKGDWQVKSPDVEPGGWAFEFMNDWYPDVDDSGFVMLAIXNIRVRDKKHQEQAIKRGIAWCLEMQSENGGWGAFDKDNTKYLLNKIPFADLEALIDPPTADLTGRMLELMGNFDYSASYPAAVRALEFLKKEQEPEGPWWGRWGVNYIYGTWSVLCGLEAIGEDMSQPYIRKAVNWLKSKQNLDGGWGE

SEQ ID NO: 299 - protein, 294 aa, Unknown
  uncultured organism
SPVWDTALVLVAMQEAGVPVDHPALIKSAQWLLDLEVRRKGDWHVKSPDLEPGGWAFESLNDWYPDVDDSGFVMLFIKDIKVRDKKLKDQAIKCGIAWCLGMQSENGGWGAFDKDNTKHLLNKIPFADLEALIDPPTADLTGRMLELMGNFNYPKSHQAAVKALDFLKVEQEPEGPWWGRWGVNYIYGTWSVLCGLEAIGEDMSQPYIKKAVNWLKSKQNLDGGWGEVCDSYADRSLMGCGPSTASQTSWALLSLFAAGEVSSKAALRGVEYLLSTQKLDGTWDEDAFTGTGFP

SEQ ID NO: 300 - protein, 294 aa, Unknown
  uncultured organism
  misc_feature (15)..(15): Xaa can be any naturally occurring amino acid
  misc_feature (21)..(21): Xaa can be any naturally occurring amino acid
  misc_feature (38)..(39): Xaa can be any naturally occurring amino acid
  misc_feature (58)..(58): Xaa can be any naturally occurring amino acid
  misc_feature (79)..(79): Xaa can be any naturally occurring amino acid
  misc_feature (128)..(128): Xaa can be any naturally occurring amino acid
  misc_feature (139)..(139): Xaa can be any naturally occurring amino acid
  misc_feature (168)..(168): Xaa can be any naturally occurring amino acid
  misc_feature (171)..(171): Xaa can be any naturally occurring amino acid
  misc_feature (174)..(174): Xaa can be any naturally occurring amino acid
SPVWDTALVLVAMQXAGVPVXHPALVKSAQWLLDLEVXXKGDWQVKSPELEPGGWAFXFLNDWYPDVDDSGFVMLSIKXIKVRDKKHKEQAIKRGISWCLGMQSDNGGWAAFDKNNTKYLLNKIPFAXLEALIDPPTAXLTGRMLELMGNFNYPKTHKAAVQALEFLXMEXEPXGPWWGRWGVNYIYGTWSVLCGLEAIGEDMAQPYIKKSINWLKSKQNMDGGWGEVCESYGDRSLMGCGPSTASQTSWALLSLFAAGEVHSKAATRGIEYLLATQKLDGTWDEDAYTGTGFP

SEQ ID NO: 301 - protein, 227 aa, Unknown
  uncultured organism
SPVWDTALALVAMQEAGVPKDHPALVKAAQWLLDLEVRRKGDWQIKSPELEPGGWAFEFLNDWYPDVDDSGFVIMAIRDIKAPDKKHKEQAIKRGIAWCLGMQSKNGGWGAFDKDNTKHLLNKIPFADLEALIDPPTADLTGRMLELMGSFDYPMDHPAAARALEFLKKEQEPEGPWWGRWGVNYIYGTWSVLCGLESIGEDMSQPYIKKAVNWLKSKQNMDGGWGE

SEQ ID NO: 302 - protein, 294 aa, Unknown
  uncultured organism
SPVWDTSLVLVAMQEAGVPVDHPALVKAAQWLLDREVRLKGDWRVKSPDLEPGGWAFEFLNDWYPDVDDSGFVMLALKDIKVRDKKQKSQAIKRGIAWCLGMQSANGGWGAFDKDNTKYLLNKIPFADLEALIDPPTADLTGRMLELMGTFNYPKSHVAVVRALGFLKSVQEPEGPWWGRWGVNYIYGTWSVLGGLDAIGEDMSQPYIRKAVNWLKSKQNLDGGWGEVCETYEDRSLMGCGPSTPSQTSWALLSLFSAGEINAKAVLRGIKYLVETQNQDGSWDEDAYTGTGFP

SEQ ID NO: 303 - protein, 227 aa, Unknown
  uncultured organism
SPVWDTALVLVAMQEAGVPLDHPALVKAAQWLLDREVRIKGDWRIKSPDIEPGGWAFEFLNDWYPDVDDSGFVMLAIKDVKVRDKKKKEQAIKRGINWCLGMQSANGGWGAFDKDNTKYLLNKIPFADLEALIDPPTADLTGRMLELLGTFNFPKDHHAIERALEFIQLEQEPEGPWWGRWGVNYIYGTWSVISGLEAIGEDMSQPYIRKTVNWLKSKQNMDGGWGE

SEQ ID NO: 304 - protein, 294 aa, Unknown
  uncultured organism
  misc_feature (22)..(22): Xaa can be any naturally occurring amino acid
SPVWDTPWMVMALLEAGVPTDXPGLLRAGRWLISKQITGVHGDWAVKNRHALPGGWSFEFENDYFPDVDDTIEVLHVIHRLAIPWEEKSECCRLGLDWLLSMQNDDGGWGAFDRNQTLVMVNRIPFSDHAACLDPSSPDIVGRVLEFLASRSFSREHPAVKRALDYIWREQSPFGGWWARWGIDYLYGTWCVLTGLRAIGWDMEDPRVRKAVAWLESVARPDGGYGESPESYRDHSYVEWKRSVPSQTAWALMGLVAGGVGHGKAARGAADYLLTSRNAQGGWDEMDYTGTGFP

SEQ ID NO: 305 - protein, 294 aa, Unknown
  uncultured organism
  misc_feature (24)..(24): Xaa can be any naturally occurring amino acid
  misc_feature (36)..(36): Xaa can be any naturally occurring amino acid
  misc_feature (99)..(99): Xaa can be any naturally occurring amino acid
  misc_feature (103)..(103): Xaa can be any naturally occurring amino acid
  misc_feature (117)..(117): Xaa can be any naturally occurring amino acid
  misc_feature (151)..(151): Xaa can be any naturally occurring amino acid
  misc_feature (173)..(173): Xaa can be any naturally occurring amino acid
  misc_feature (202)..(202): Xaa can be any naturally occurring amino acid
SPVWDTPWMVMALLEAGCPANDPXLIRAGRWLKAKXITEVRGDWAVKNRKALPGGWSFEFENDYFPDVDDTIEVLSVIHRLSIPWNEKAKSCRLGLEWXLSMXNRDGGWGAFDREQXFKVVNRIPFSDHAACLDPSSPDITGRMVEFLASXNFSKGHVAVRRALDYIWKQQAXFGGWWARWGIDYLYGTWCVLTGLASLGFXMDDPRARKAADWLESIQHADGGFGESPESYREDSFVDWKRSVPSQTAWALMGLVAAGRASGAAAQRAAAWLLDNRNTNGSWDEQDYTGTGFP

SEQ ID NO: 306 - protein, 294 aa, Unknown
  uncultured organism
SPVWDTPWTVMALLEAGVPSNDPALLRSGRWLLAKQITDTKGDWAIKNKNTAPGGWSFEFENKYFPDVDDTIEVLHCLHKLAIPWREKEKPCRLGIDWLLSMQNDDGGWGAFDKNQKRQVVNRIPFSDHGACLDPSSPDITGRMIEFLATQKFNSEYESVKRALKYIWKTQEDFGGWHARWGINYIYGTWCVLTGLRAIGFNMTDRRVQKALNWLESIQNKDGGFGESPASYEECRYIPWKESVPSQTAWALMALVAGGGAGSAPAENAATFLINYRNSNGVWDEECYTGTGFP

SEQ ID NO: 307 - protein, 295 aa, Unknown
  uncultured organism
SPVWDTPWMIEALLETGVPPGDPALLRAGRWLMSKQITGVRGDWAMKSPKGKPGGWAFEFENDYYPDVDDTIQVLTALCKLSIPWREKEKAVMQGIDWLISMQNDDGGWGAFDRNQTRWIVNRIPFSDHKACLDPSSPDITGRMVEFLMRRNYSTSHPSVKKALKYIRETQEDFGAWFARWGINYIYGTWCVLTALAAMGIGHTDSRVAKAVAWLSSVQRPDGGFSEAADTYHPHKPFESYSESVPSQSAWALMGLVAGGAVHSPAAARAACYLINNRNLNNGWDERHYTGTGFP

SEQ ID NO: 308 - protein, 226 aa, Unknown
  uncultured organism
SPVWDTAIAGYALGESGCAPQSALRRMADWLLTKEVRRKDDWSVKRPDVEPSGWYFEFANEFYPDTDDTAMVLLSLLHGRATNPAAQEACAKRAVNWLLAMQSKDGGWAAFDVDNDWKPLSYVPFADHNAMLDPSCPDITGRVLEALCKYGVSQEHPAVLRAIDYLIQTQEQDGSWHGRWGVNYVYGTFLALRGLKAAGVSDREAYVLRAGEWLDLIQNPDGGWGE

SEQ ID NO: 309 - protein, 226 aa, Unknown
  uncultured organism
SPVWDTVLSITALADADLPRTHPAMRRAVAWVLGKQVLCEGDWRVKNRRGEPGGWSFEFNNNFYQDNDDTAAVLIALHKARLPDEAKGEAMQRGLRWLLSMQCDDGGWSAFDVNNNKRLLNKIPFADLESMLDPSTCDLTGRTLEALGSIGFPFTHRIVQHAVRFIRQHQEADGAWYGRWGVNYIYGTCHVLCGLLSVGEDMHQPYVQRAVQWLIEHQNADGGWGE

SEQ ID NO: 310 - protein, 226 aa, Unknown
  uncultured organism
SPVWDTALAVRALAAAGLPPEHPAMVKASEWLLTQQIFKPGDWSVKCPDLPPGGWAFEFVNNWYPDVDDSSMVLVALKEGLADAAKHQAALQRGINWCLGMQSKNGGFASFDKDNTKEWLNAIPFGDLKALVDPPTEDITARILEMMGAFGHGLDHPVAVRGLAYLHQTQRPEGPWWGRWGVNYIYGTWSVLVALKRIGEDMSRPYVRRAVDWVKAHQNPDGGWGE

SEQ ID NO: 311 - protein, 226 aa, Unknown
  uncultured organism
SPVWDTALAVRALAAAGLPPEHPAMVKASEWLLTQQIFKPGDWSVKCPDLPPGGWAFEFVNNWYPDVDDSSMVLVALKDGLVDAAKHQAALQRGINWCLGMQSKNGGFASFDKDNTKEWLNAIPFGDLKALVDPPTEDITARILEMMGAFGHGLDHPVAVRALAYLHQTQRPEGPWWGRWGVNYIYGTWSVLVALKRIGEDMNRPYVRRAVDWVKAHQNLDGGWGE

SEQ ID NO: 312 - protein, 293 aa, Unknown
  uncultured organism
SPVWDTALAVRALAAAGVPPEHPAMVQASEWLLTQQIFKPGDWSVKCPDLPPGGWAFEFVNNWYPDVDDSSMVLVALKDGLADAAKHQAALQRGINWCLGMQSKNGGFASFDKDNTKEWLNAIPFGDLKALVDPPTEDITARILEMMGAFGHGLDHPVAVRAMAYLHETQRPEGPWWGRWGVNYIYGTWSVLVALKRIGEDMSRPYVRRAVDWVKAHQNLDGGWGECCESYRNPELMGRGPSTASQTAWALLGLFASGEVHTPEVKAGVDYLVKTQNSLGRWDEEQFTGTGFP

SEQ ID NO: 313 - protein, 226 aa, Unknown
  uncultured organism
SPIWDTALAVRALTAAGMPPEHPAMVKASEWLLTQQIFKPGDWSVKCPDLPPGGWAFEFVNNWYPDVDDSSMVLVALKEGLADTAKHQAALQRGINWCLGMQSKNGGFASFDKDNTKEWLNAIPFGDLKALVDPPTEDITARILEMMGAFGHGLDHPVAVRALAYLHETQRPGGPWWGRWGVNYLYGTWSVLVALKRIGEDMSRPYVRRAVDWVKDHQNLDGGWGE

SEQ ID NO: 314 - protein, 293 aa, Unknown
  uncultured organism
SPVWDTALAVRALAAAGVPPEHPAMVKASEWLLTQQIFKPGDWSIKCPDLPPGGWAFEFVNNWYPDVDDSSMVLVALKDGLADAAKHQAALQRGINWCLGMQSKNGGFASFDKDNTKEWLNSLPFGDLKALVDPPTEDITARILEMMGAFGHGLDHPVAARALAYLHQTQRPEGPWWGRWGVNYIYGTWSVLVALKRIGEDMSRPYVRRAVDWVKAHQNPDGGWGEFCESYRNPELMGKGPSTASQTAWALLGLFAAGEVHAPEVTAGVDYLVKTQDSLGRWDEEQFTGTGFP

SEQ ID NO: 315 - protein, 293 aa, Unknown
  uncultured organism
  misc_feature (58)..(58): Xaa can be any naturally occurring amino acid
  misc_feature (200)..(200): Xaa can be any naturally occurring amino acid
SPVWDTALAVRALAAAGLPPDHPFMTQATSWLLTQQIFKPGDWCIKCPDLPPGGWAFXFHNNWYPDVDDSSMVLVALKDGLPDTARHQAALQRGINWCLGMQSKNGGFASFDKDNTKEWLNALPFGDLKALVDPPTEDITARILEMMGAFGHGLDHPTADRALAFLRRTQHPEGPWWGRWGVNYLYGTWSVLVALKRIGXDMSRPYVQRAVNWIKSHQNPDGGWGEVCESYRHPELMGQGPSTASQTAWALLGLLAAGEIQAAEVKAGVDYLVKTQNAQGRWDEKYFTGNWLP

SEQ ID NO: 316 - protein, 231 aa, Unknown
  uncultured organism
SPVWDTAWAVIGLCESGMERTHPAVRSAIRWLYSMQILRPGDWAVKNPLTEPGGWAFEFHNDFYPDNDDTAAVLMGLLFSDLNDEENHRAFERGVRWLLSMQNNDSGWGAFERNVDNKIFDQIPFNDQKNMLDPSTADVTGRVVELLGRIGRRLGGSFSDEPYVRQAIEFLKNEQEPEGCWFGRWGVNYIYGTWSVLVALEAIGESMRAPYIRKAVNWVKKVQNPDGGWGE

SEQ ID NO: 317 - protein, 226 aa, Unknown
  uncultured organism
  misc_feature (105)..(105): Xaa can be any naturally occurring amino acid
  misc_feature (202)..(202): Xaa can be any naturally occurring amino acid
SPVWDTILGMIGLVDCGHDGKDPLLVTARDWIVKRQLLVNYGDWKVYNPNGPSGGWSFEYDNSWYPDVDDTAAIVIGFLKQDYEFRHSEVVKRACDWIASMQNQXGGWAAFDINNDKTFLNEIPFSDMESLCDPSSPDVVGRVLEAFGILNDPKYAEVCRRGIEYLRRTQESEGSWFGRWGVNYVYGTSNVLCSLKRQDVAXKDPMVTRALTWLKKVQNKDGGWGE

SEQ ID NO: 318 - protein, 225 aa, Unknown
  uncultured organism
SPVWDTGLALHALLESGMDPDDPAIAKAMHWLDEREITDVAGDWAEQRPGLAPGGWAFQYRNDHYPDVDDTAVVGMAMHRANPQARPETLERTRAWIEGMQSQNGGWGAFDADNTHYHLNHIPFADHGAMLDPPTADVSARCLGMLSQMGYDRDHPSIQRAIAYLKNDQEEDGSWFGRWGTNYIYGTWSVLSALNAAGEDMSQPYIRKAVDYLTNFQREDGGWGE

SEQ ID NO: 319 - protein, 225 aa, Unknown
  uncultured organism
SPVWDTSLSAHALMEAGLEENDKRLEGLLDWLKDLQILDVKGDWVARRPDVRPGGWAFQYRNDHYPDVDDTAVVAMAMHRQGDEKYKEAIDRAAEWIVGMQSSSGGWGAFDPENEHFYLNSIPFADHGALLDPPTEDVTARCVGFLAQLDPDAYAEPIKRGVEFLKRTQQEDGSWWGRWGANFVYGTWSVLCALNAAGEDPKSPYIQKAVAWLKSRQREDGGWGE

SEQ ID NO: 320 - protein, 225 aa, Unknown
  uncultured organism
  misc_feature (163)..(163): Xaa can be any naturally occurring amino acid
SPVWDTCLGLHALLEAGEPREAPSVKKAVDWLLEREITETYGDWVWRRPHLKPSGWAFQYWNNYYPDVDDTAVVVMALDRVGDPRCRPAIERACEWIIGMQSTSGGWGSFDPENEFTYLNHIPFADHGALLDPPTVDVTARCISMLAQVGYRHDHPAIRKSVXFILREQEKDGSWYGRWGTNYVYGTWSALSALNAVGEDMSSPVVRKGVAWLEAFQQPDGGWGE

SEQ ID NO: 321 - protein, 225 aa, Unknown
  uncultured organism
  misc_feature (129)..(129): Xaa can be any naturally occurring amino acid
  misc_feature (136)..(136): Xaa can be any naturally occurring amino acid
  misc_feature (193)..(193): Xaa can be any naturally occurring amino acid
  misc_feature (208)..(208): Xaa can be any naturally occurring amino acid
  misc_feature (215)..(215): Xaa can be any naturally occurring amino acid
SPVWDTGIACQALQEVGGPAADAGVQRALDWLVERQLRDEPGDWRRDRPDLEGGGWAFQYNNPHYPDLDDTSMVAWVMQVADHGRYREEIRRAAKWVVGMRSEGGGFASFEVDNTYYYLNHIPFADHGXLLDPPTXDVTARCIAVLAITDRAQHETVIREAIDFLFVDQEEDGSWFGRWGTDYIYGTWSVLSXLDVVGFDMRDARVRXSVEWLFXQQNPDGGWGE

SEQ ID NO: 322 - protein, 224 aa, Unknown
  uncultured organism
SPVWDTGIAAHALGEAGHASAMQSTADWLLTKEVRRKGDWSVKRPDVEPSGWYFEFANEFYPDIDDTAQVLLGLAHAKASDPAKQKACMDRAVAWLLAMQGSDGGWAAFDVDNNWEFLSSVPFADHNAMLDPTCPDITGRVLEALAACGVPNSHPAVKRGVEFLRNSVEKDGSWYGRWGVNYIYGTYLALRGLRASGEDDREAHILRAGEWLRAIQNADGGWGE

SEQ ID NO: 323 - protein, 224 aa, Unknown
  uncultured organism
SPMWDTSLAAHAFLESGDREDPRLIRALDWLVDKQILDHVGDWAVRRPGLRPGGWAFQYENPDYPDVDDTAVVAMAMHRTDPERYAENIDRACEWLAGMQSKNGGWGAFDPENEHYYLNSIPFADHGALLDPPTVDVTARCIGCLAQVDAEAFADNIKRGIGFIKREQEPDGSWFGRWGANYIYGTWSALVALKGAGEDMSQPYIRKSVAWLKGRQGPDGGWGE

SEQ ID NO: 324 - protein, 224 aa, Unknown
  uncultured organism
SPVWDTSLAAHALLEAGEPNDPEVIGLLDWLKDKQILTTVGDWSARRPNLRPGGWAFQYENPHYPDVDDTAVVAMAMHRQGDPKYAEAIARACEWLAGMQSSSGGWGAFDPENEHFYLNSIPFADHGALLDPPTVDVTARCVGCLAQVDAERFASEIQAGIDYIKREQEEDGSWFGRWGANYVYGTWSALVALNKAGEDMNTPYIRRAVDWLKARQRPDGGWGE

SEQ ID NO: 325 - protein, 640 aa, Verrucomicrobium spinosum
MATSDPSLAEAIQNTRAHLLSLRNARGHWEGHLSNSALSTATAIVALHLVDAPLHSARIAQGVRWLVLHQNKDGGWGDTTLSKSNLSTTLLCWSALSLCEPDRTEPIQHCEAWIKERTGSLEPEVICRAVVARYGKDKTFSVPILMLCAIGGRLGPEKEAWSRVLALPFELAAMPREWFGAIGLPVVSYALPALIAIGYARFYHAPPSLLNPLHALRKALWPRISPMLKLLQPSTGGYLEATPLTSFVTMALASAGEKFHPCVPEAVRFLEDSQRPDGSWPIDTNLATWGTTLSTKALTATSEGREALDIPALKSWLLEQQYQEIHPFTNAAPGGWAWTDLPGGVPDADDTSGALVALWHLCEDEAERQALAPAVAKGVQWLMDLQNRDGGIPTFCRGWGTLPFDRSTPEITAHALHAWGLWQVVLPEELQQEVSLRIPRAIAFIARPPSRGAPGFNHVPLWFGNEHAKEEENHVYGTAQIMNHLLSSGLNTPEIKVILETGHRNLLAWQQLDGGWSGSETGPASLEETAVSVAALALHTLHAGNRTRSSAEDAVAKGTQWLVQHTATGTTFPSAPIGLYFARLWYHEQLYPVIWTLGALHAVETLSAAALPLRARASAPPQHPGVVRTKPIHIAPPSDP

SEQ ID NO: 326 - protein, 649 aa, Acidiphilium cryptum
MFDTISFDFDALDQAISRAHARLSAEQRADGHYVYELEADATIPAEYVLLEHFLDRIDPELEARIGVFLRGIQGNSPQNPGGWPLFHDGAMDISASVKAYFALKAIGDDPDAPHMRRAREAILARGGAARTNVFTRIQLALFGAVPWRACPVMPVEIMLLPDWFPITIWKISYWSRTVIAPLLVLLTERPIARNPRNVRIDELFVTPPDQVTDYIRGPYRSNWGYLFKAIDSALRPLERHFPARSRKRAIQAAIDFITPRLNGEDGLGAIYPAMANTVMMYHTLGYSPDHPDYATAWASVRKLVTDASYRFEGASYVQPCLSPVWDTSLAAHALAEAGSPGDAQLAAACDWLIPRQILDVKGDWAYRKPDAPPGGWAFQYNNAHYPDVDDTAVVGMILDRNGDPAHREAVERARQWILGMQSRSGGWGAFDSDNEFHYLNHIPFADHGALLDPPTADVTARCISFLAQLGHAEDRPAIERGVAYLRREQEQDGSWFGRWGTNYIYGTWSSLCALNAAGVAQDDPMMVRAVEWLLARQRPDGGWGEDCETYAHAKPGEYHESLPSQTAWALLGLMAAGQAEHEAVARGIAWLQSVQEDDGSWTEQPYNAVGFPRVFYLRYHGYPRFFPLLAMARYRNLARGNSRQVQFGF

SEQ ID NO: 327 - DNA, 25 bp, Artificial Sequence
  PCR Primer
gcgctgtttcatatgggtattgaca

SEQ ID NO: 328 - DNA, 25 bp, Artificial Sequence
  PCR Primer
gcgcttaccctggatcctcgaaaat

The invention claimed is:

1. A process for the preparation of 3a,6,6,9a-tetramethyl-dodecahydronaphto[2,1-b]furan (ambroxide), wherein
   a) homofarnesylic acid of the formula Ia

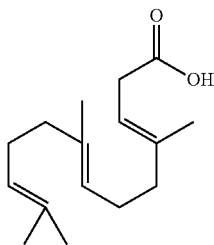

(Ia)

is converted into sclareolide of the formula IIa

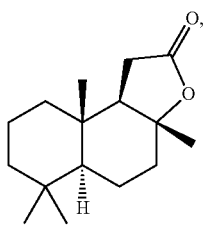

(IIa)

wherein homofarnesylic acid of the formula Ia is brought into contact with a squalene-hopene cyclase (SHC), which is capable of cyclizing a polyunsaturated carboxylic acid, in particular homofarnesylic acid; wherein the SHC is produced from the transgenic SHC-overexpressing strain *E. coli* LU 15568;
   b) sclareolide of the formula IIa from step a) is reduced chemically to ambroxidol, and
   c) ambroxidol from step b) is cyclized chemically to ambroxide;
wherein the SHC is selected from among:
   a) a polypeptide with the amino acid sequence of SEQ ID NO: 2,
   b) proteins obtained by deletion, insertion, substitution, addition, inversion or a combination of proteins derived as per a), comprising a polypeptide with a sequence identity of at least 90%, to the amino acid sequence as per SEQ ID NO: 2; and
   c) proteins which catalyze the cyclization of homofarnesylic acid to sclareolide and comprise the amino acid sequence as per SEQ ID NO: 3, 4, 5, or 6, or with a sequence identity of at last 90% to the amino acid sequence of SEQ ID NO: 3, 4, 5, or 6.

2. The process as claimed in claim 1, wherein homofarnesylic acid is employed in essentially stereoisomerically pure form as the starting material.

3. The process as claimed in claim 1, wherein sclareolide is obtained in stereoisomerically pure form or as a mixture of stereoisomers.

4. The process as claimed in claim 1, wherein the biocatalytic conversion is carried out:
   a) at a pH value of the reaction medium in the range from approximately 4 to 5.8, in particular 4.5 to 5.5; and under at least one of the following further conditions:
   b) at a substrate concentration of at least 15 mM, in particular 15 to 30 mM;
   c) at an enzyme concentration of at least 5 mg/ml;
   d) at a reaction temperature in the range from 32 to 40° C., in particular 35 to 38° C.;
   e) in a sodium citrate buffer comprising 1 to 20 mM $MgCl_2$; and/or
   f) at a buffer concentration of approximately 10 to 100 mM.

5. The process as claimed in claim 1, wherein the SHC is present in a form selected from among:
   a) a free, optionally partially or fully purified natural or recombinantly produced cyclase,
   b) cyclase as per a) in immobilized form;
   c) intact cells, comprising at least one cyclase;
   d) cell lysates or cell homogenates of cells as per c).

6. The process as claimed in claim 1, wherein the conversion is carried out in one-phase aqueous systems or in two-phase aqueous-organic or solid-liquid systems.

7. The process as claimed in claim 1, wherein the conversion is carried out at a temperature of approximately 37° C., and a pH value in the range of from 5 to 5.2.

8. The process as claimed in claim 1, wherein the SHC is isolated from a microorganism selected among *Methylococcus capsalatus, Rhodopseudomonas palustris, Bradyrhizobium japonicum, Frankia* spec., *Streptomyces coelicolor* and in particular *Zymomonas mobilis*.

9. The process as claimed in claim 1, wherein the SHC is isolated from an SHC-overexpressing microorganism which is selected among bacteria of the genus *Escherichia, Corynebacterium, Ralstonia, Clostridium, Pseudomonas, Bacillus, Zymomonas, Rhodobacter, Streptomyces, Burkholderia, Lactobacillus* and *Lactococcus*, in particular *Escherichia*.

10. The process as claimed in claim 1, wherein the SHC is produced from the transgenic SHC-overexpressing strain *E. coli* LU 15568, prepared by transformation of the strain *E. coli* TG10 pAgro4 pHSG575 with the plasmid pDHE-Zm-SHC-1.

11. The process as claimed in claim 1, wherein ambroxide is (-)-ambroxide ((3aR,5aS,9aS,9bR)-3a,6,6,9a-tetramethyl-dodecahydronaphto[2,1-b]furan {CAS 6790-58-5}).

* * * * *